US011414708B2

(12) United States Patent
Davicioni et al.

(10) Patent No.: US 11,414,708 B2
(45) Date of Patent: Aug. 16, 2022

(54) USE OF GENOMIC SIGNATURES TO PREDICT RESPONSIVENESS OF PATIENTS WITH PROSTATE CANCER TO POST-OPERATIVE RADIATION THERAPY

(71) Applicants: DECIPHER BIOSCIENCES, INC., San Diego, CA (US); THE REGENTS OF THE UNIVERSITY OF MICHIGAN, Ann Arbor, MI (US)

(72) Inventors: Elai Davicioni, La Jolla, CA (US); Hussam Al-Deen Ashab, Vancouver (CA); Nicholas Erho, Vancouver (CA); Shuang G. Zhao, Ann Arbor, MI (US); Sei-Won Laura Chang, Ann Arbor, MI (US); Felix Y. Feng, Hillsborough, CA (US)

(73) Assignee: Decipher Biosciences, Inc., San Diego, CA (US)

( * ) Notice: Subject to any disclaimer, the term of this patent is extended or adjusted under 35 U.S.C. 154(b) by 334 days.

(21) Appl. No.: 16/327,260

(22) PCT Filed: Aug. 24, 2017

(86) PCT No.: PCT/US2017/048486
§ 371 (c)(1),
(2) Date: Feb. 21, 2019

(87) PCT Pub. No.: WO2018/039490
PCT Pub. Date: Mar. 1, 2018

(65) Prior Publication Data
US 2019/0218621 A1    Jul. 18, 2019

Related U.S. Application Data

(60) Provisional application No. 62/379,178, filed on Aug. 24, 2016.

(51) Int. Cl.
| | | |
|---|---|---|
| *C07H 21/04* | (2006.01) |
| *C12Q 1/68* | (2018.01) |
| *C12Q 1/6886* | (2018.01) |
| *G16B 25/10* | (2019.01) |
| *G01N 33/574* | (2006.01) |
| *G01N 33/48* | (2006.01) |
| *G16B 20/00* | (2019.01) |
| *G16H 50/30* | (2018.01) |
| *G16H 50/20* | (2018.01) |
| *G16B 25/20* | (2019.01) |
| *G16B 40/30* | (2019.01) |
| *G16B 40/20* | (2019.01) |

(52) U.S. Cl.
CPC .......... *C12Q 1/6886* (2013.01); *G01N 33/48* (2013.01); *G01N 33/574* (2013.01); *G16B 20/00* (2019.02); *G16B 25/10* (2019.02); *G16B 25/20* (2019.02); *G16H 50/20* (2018.01); *G16H 50/30* (2018.01); *C12Q 2600/106* (2013.01); *C12Q 2600/118* (2013.01); *C12Q 2600/158* (2013.01); *G16B 40/20* (2019.02); *G16B 40/30* (2019.02)

(58) Field of Classification Search
None
See application file for complete search history.

(56) References Cited

U.S. PATENT DOCUMENTS

| | | |
|---|---|---|
| 3,645,691 A | 2/1972 | Guenter et al. |
| 3,687,808 A | 8/1972 | Thomas, Jr. et al. |
| 4,323,546 A | 4/1982 | Crockfor et al. |
| 4,683,195 A | 7/1987 | Mullis et al. |
| 4,683,202 A | 7/1987 | Mullis et al. |
| 4,800,159 A | 1/1989 | Mullis et al. |
| 4,965,188 A | 10/1990 | Mullis et al. |
| 5,130,238 A | 7/1992 | Malek et al. |
| 5,143,854 A | 9/1992 | Pinung et al. |
| 5,225,326 A | 7/1993 | Bresser et al. |
| 5,270,184 A | 12/1993 | Walker et al. |
| 5,283,174 A | 2/1994 | Arnold et al. |
| 5,288,514 A | 2/1994 | Ellman |
| 5,384,261 A | 1/1995 | Winkle et al. |
| 5,399,491 A | 3/1995 | Kacian et al. |
| 5,455,166 A | 10/1995 | Walker |
| 5,480,784 A | 1/1996 | Kacian et al. |
| 5,494,810 A | 2/1996 | Barany et al. |
| 5,538,848 A | 7/1996 | Livak et al. |
| 5,545,524 A | 8/1996 | Trent et al. |

(Continued)

FOREIGN PATENT DOCUMENTS

| | | |
|---|---|---|
| EP | 0 684 315 | 11/1995 |
| EP | 1 409 727 | 11/2005 |

(Continued)

OTHER PUBLICATIONS

US 5,962,233 A, 10/1999, Livak et al. (withdrawn)

(Continued)

*Primary Examiner* — Jeanine A Goldberg

(74) *Attorney, Agent, or Firm* — Knobbe, Martens, Olson & Bear, LLP

(57) ABSTRACT

Methods, compositions, and kits for identifying individuals who will be responsive to post-operative radiation therapy for treatment of prostate cancer are disclosed. In particular, the invention relates to a genomic signature based on expression levels of DNA Damage Repair genes that can be used to identify individuals likely to benefit from post-operative radiation therapy after a prostatectomy.

9 Claims, 8 Drawing Sheets

Specification includes a Sequence Listing.

(56) References Cited

U.S. PATENT DOCUMENTS

| | | |
|---|---|---|
| 5,677,195 A | 10/1997 | Winkler et al. |
| 5,705,365 A | 1/1998 | Ryder et al. |
| 5,710,029 A | 1/1998 | Ryder et al. |
| 5,711,029 A | 1/1998 | Ryder et al. |
| 5,744,305 A | 4/1998 | Fodor et al. |
| 5,814,447 A | 9/1998 | Ishiguro et al. |
| 5,824,518 A | 10/1998 | Kacian et al. |
| 5,830,711 A | 11/1998 | Barany et al. |
| 5,846,717 A | 12/1998 | Brow et al. |
| 5,854,033 A | 12/1998 | Lizardi |
| 5,854,206 A | 12/1998 | Twardzik et al. |
| 5,888,779 A | 3/1999 | Kacian et al. |
| 5,925,517 A | 7/1999 | Tyagi et al. |
| 5,928,862 A | 7/1999 | Morrison |
| 5,965,360 A | 10/1999 | Zain et al. |
| 5,985,557 A | 11/1999 | Prudent et al. |
| 5,989,815 A | 11/1999 | Skolnick et al. |
| 5,994,069 A | 11/1999 | Hall et al. |
| 6,001,567 A | 12/1999 | Brow et al. |
| 6,022,692 A | 2/2000 | Coulie et al. |
| 6,027,887 A | 2/2000 | Zavada et al. |
| 6,034,218 A | 3/2000 | Reed et al. |
| 6,090,543 A | 7/2000 | Prudent et al. |
| 6,121,489 A | 9/2000 | Dorner et al. |
| 6,136,182 A | 10/2000 | Dolan et al. |
| 6,150,097 A | 11/2000 | Tyagi et al. |
| 6,198,107 B1 | 3/2001 | Seville |
| 6,218,523 B1 | 4/2001 | French |
| 6,225,051 B1 | 5/2001 | Sugiyama et al. |
| 6,251,639 B1 | 6/2001 | Kurn |
| 6,262,245 B1 | 7/2001 | Xu et al. |
| 6,268,142 B1 | 7/2001 | Duff et al. |
| 6,303,305 B1 | 10/2001 | Wittwer et al. |
| 6,410,278 B1 | 6/2002 | Notomi et al. |
| 6,436,642 B1 | 8/2002 | Gould-Rothberg et al. |
| 6,541,205 B1 | 4/2003 | Yokoyama et al. |
| 6,573,043 B1 | 6/2003 | Cohen et al. |
| 6,630,358 B1 | 10/2003 | Wagner et al. |
| 6,723,506 B2 | 4/2004 | Fletcher et al. |
| 6,828,429 B1 | 12/2004 | Srivastava et al. |
| 7,008,765 B1 | 3/2006 | Bussemakers et al. |
| 7,186,514 B2 | 3/2007 | Zavada et al. |
| 7,211,390 B2 | 5/2007 | Rothberg et al. |
| 7,244,559 B2 | 7/2007 | Rothberg et al. |
| 7,264,929 B2 | 9/2007 | Rothberg et al. |
| 7,280,922 B2 | 10/2007 | Mei et al. |
| 7,300,788 B2 | 11/2007 | Matsuzaki et al. |
| 7,319,011 B2 | 1/2008 | Riggins et al. |
| 7,323,305 B2 | 1/2008 | Leamon et al. |
| 7,335,762 B2 | 2/2008 | Rothberg et al. |
| 7,358,061 B2 | 4/2008 | Yamamoto et al. |
| 7,361,488 B2 | 4/2008 | Fan et al. |
| 7,378,233 B2 | 5/2008 | Sidransky et al. |
| 7,407,755 B2 | 8/2008 | Lubinski et al. |
| 7,541,169 B2 | 6/2009 | Freimuth et al. |
| 7,598,052 B2 | 10/2009 | Giordanos et al. |
| 7,662,553 B2 | 2/2010 | Lenz et al. |
| 7,767,391 B2 | 8/2010 | Scott et al. |
| 7,901,881 B2 | 3/2011 | Libutti et al. |
| 7,901,888 B2 | 3/2011 | Kebebew |
| 7,914,988 B1 | 3/2011 | Chudin et al. |
| 7,927,826 B2 | 4/2011 | Riggins et al. |
| 8,008,009 B2 | 8/2011 | Choquet-Kastylevsky et al. |
| 8,202,692 B2 | 6/2012 | Giordano et al. |
| 8,273,539 B2 | 9/2012 | Klee et al. |
| 8,293,880 B2 | 10/2012 | Cote et al. |
| 8,299,233 B2 | 10/2012 | Andre et al. |
| 8,338,109 B2 | 12/2012 | Vasmatzis et al. |
| 8,354,228 B2 | 1/2013 | Ron |
| 8,465,914 B2 | 6/2013 | Brown et al. |
| 8,541,170 B2 | 9/2013 | Kennedy et al. |
| 8,568,971 B2 | 10/2013 | Brown et al. |
| 8,669,057 B2 | 3/2014 | Kennedy et al. |
| 8,802,599 B2 | 8/2014 | Aharonov et al. |
| 8,828,656 B2 | 9/2014 | Bullerdiek et al. |
| 8,877,445 B2 | 11/2014 | Shackney |
| 8,945,829 B2 | 2/2015 | Keutgen et al. |
| 9,040,286 B2 | 5/2015 | Zon et al. |
| 9,074,258 B2 | 7/2015 | Davicion et al. |
| 9,096,906 B2 | 8/2015 | Aharonov et al. |
| 9,157,123 B2 | 10/2015 | Xing |
| 9,175,352 B2 | 11/2015 | Keutgen et al. |
| 9,206,481 B2 | 12/2015 | Srivastava et al. |
| 9,206,482 B2 | 12/2015 | Davicioni et al. |
| 9,234,244 B2 | 1/2016 | Zeiger et al. |
| 9,435,812 B2 | 9/2016 | Pestano et al. |
| 9,495,515 B1 | 11/2016 | Giulia et al. |
| 9,534,249 B2 | 1/2017 | Vasmatzis et al. |
| 9,587,279 B2 | 3/2017 | Fahey, III et al. |
| 9,617,604 B2 | 4/2017 | Davicion et al. |
| 9,631,239 B2 | 4/2017 | Perou |
| 9,708,667 B2 | 7/2017 | Yanai et al. |
| 9,714,452 B2 | 7/2017 | Davicioni et al. |
| 9,856,537 B2 | 1/2018 | Kennedy et al. |
| 9,994,907 B2 | 6/2018 | Davicioni et al. |
| 10,114,924 B2 | 10/2018 | Kennedy et al. |
| 10,407,731 B2 | 9/2019 | Klee et al. |
| 10,407,735 B2 | 9/2019 | Chinnaiyan et al. |
| 10,422,009 B2 | 9/2019 | Davicioni et al. |
| 10,494,677 B2 | 12/2019 | Vasmatzis et al. |
| 10,513,737 B2 | 12/2019 | Davicioni et al. |
| 10,865,452 B2 | 12/2020 | Davicioni |
| 11,035,005 B2 | 6/2021 | Buerki et al. |
| 11,078,542 B2 | 8/2021 | Davicioni et al. |
| 2001/0051344 A1 | 12/2001 | Shalon et al. |
| 2002/0076735 A1 | 6/2002 | Williams et al. |
| 2002/0090633 A1 | 7/2002 | Becker et al. |
| 2002/0119463 A1 | 8/2002 | Fads |
| 2002/0168638 A1 | 11/2002 | Schlegel et al. |
| 2002/0169137 A1 | 11/2002 | Reiner et al. |
| 2002/0182586 A1 | 12/2002 | Morris et al. |
| 2003/0119168 A1 | 6/2003 | Madison et al. |
| 2003/0152980 A1 | 8/2003 | Golub et al. |
| 2003/0175736 A1 | 9/2003 | Chinnaiyan et al. |
| 2003/0185830 A1 | 10/2003 | Xu et al. |
| 2003/0186248 A1 | 10/2003 | Erlander et al. |
| 2003/0190602 A1 | 10/2003 | Pressman et al. |
| 2003/0194734 A1 | 10/2003 | Jatkoe |
| 2003/0224399 A1 | 12/2003 | Reed et al. |
| 2003/0235820 A1 | 12/2003 | Mack et al. |
| 2004/0009481 A1 | 1/2004 | Schlegel et al. |
| 2004/0018493 A1 | 1/2004 | Anastasio et al. |
| 2004/0019466 A1 | 1/2004 | Minor et al. |
| 2004/0029114 A1 | 2/2004 | Mack et al. |
| 2004/0058378 A1 | 3/2004 | Kong et al. |
| 2004/0259086 A1 | 12/2004 | Schlegel et al. |
| 2005/0042222 A1 | 2/2005 | Yamamoto et al. |
| 2005/0042638 A1 | 2/2005 | Arnold et al. |
| 2005/0048533 A1 | 3/2005 | Sidransky et al. |
| 2005/0064455 A1 | 3/2005 | Baker et al. |
| 2005/0118625 A1 | 6/2005 | Mounts |
| 2005/0137805 A1 | 6/2005 | Lewin et al. |
| 2005/0202442 A1 | 9/2005 | Morris et al. |
| 2005/0227917 A1 | 10/2005 | Williams et al. |
| 2005/0240357 A1 | 10/2005 | Minor |
| 2005/0250125 A1 | 11/2005 | Novakoff |
| 2005/0260646 A1 | 11/2005 | Baker et al. |
| 2005/0266443 A1 | 12/2005 | Croce et al. |
| 2005/0266459 A1 | 12/2005 | Poulsen |
| 2006/0019256 A1 | 1/2006 | Clarke et al. |
| 2006/0019615 A1 | 1/2006 | Ditmer |
| 2006/0035244 A1 | 2/2006 | Riggins et al. |
| 2006/0046253 A1 | 3/2006 | Nakao |
| 2006/0046265 A1 | 3/2006 | Becker et al. |
| 2006/0083744 A1 | 4/2006 | Chen et al. |
| 2006/0088851 A1 | 4/2006 | Erlander et al. |
| 2006/0094061 A1 | 5/2006 | Brys et al. |
| 2006/0105360 A1 | 5/2006 | Croce et al. |
| 2006/0127907 A1 | 6/2006 | Matsubara et al. |
| 2006/0134663 A1 | 6/2006 | Harkin et al. |
| 2006/0204989 A1 | 9/2006 | Kopreski |
| 2006/0211017 A1 | 9/2006 | Chinnaiyan et al. |
| 2007/0010469 A1 | 1/2007 | Chan |
| 2007/0020657 A1 | 1/2007 | Grebe et al. |

(56) References Cited

U.S. PATENT DOCUMENTS

| | | |
|---|---|---|
| 2007/0031873 A1 | 2/2007 | Wang et al. |
| 2007/0037165 A1 | 2/2007 | Venter et al. |
| 2007/0037186 A1 | 2/2007 | Jiang et al. |
| 2007/0048738 A1 | 3/2007 | Donkena et al. |
| 2007/0065827 A1 | 3/2007 | Pauloski et al. |
| 2007/0065833 A1 | 3/2007 | Gupta |
| 2007/0083334 A1 | 4/2007 | Mintz et al. |
| 2007/0099197 A1 | 5/2007 | Afar et al. |
| 2007/0099209 A1 | 5/2007 | Clarke et al. |
| 2007/0105133 A1 | 5/2007 | Clarke et al. |
| 2007/0148667 A1 | 6/2007 | Williams et al. |
| 2007/0148687 A1 | 6/2007 | Bedingham et al. |
| 2007/0161004 A1 | 7/2007 | Brown et al. |
| 2007/0172841 A1 | 7/2007 | Wang |
| 2007/0172844 A1 | 7/2007 | Lancaster et al. |
| 2007/0212702 A1 | 9/2007 | Tomlins et al. |
| 2007/0220621 A1 | 9/2007 | Clarke et al. |
| 2007/0238119 A1 | 10/2007 | Yu et al. |
| 2007/0259352 A1 | 11/2007 | Bentwich et al. |
| 2007/0275915 A1 | 11/2007 | Hallenbeck et al. |
| 2008/0009001 A1 | 1/2008 | Bettuzzi et al. |
| 2008/0028302 A1 | 1/2008 | Meschkat |
| 2008/0044824 A1 | 2/2008 | Giordano et al. |
| 2008/0076674 A1 | 3/2008 | Litman et al. |
| 2008/0124344 A1 | 5/2008 | Combs et al. |
| 2008/0131892 A1 | 6/2008 | Becker et al. |
| 2008/0145841 A1 | 6/2008 | Libutti et al. |
| 2008/0254470 A1 | 10/2008 | Berlkin |
| 2008/0269157 A1 | 10/2008 | Srivastava et al. |
| 2008/0274457 A1 | 11/2008 | Eng et al. |
| 2008/0281568 A1 | 11/2008 | Kao et al. |
| 2009/0020433 A1 | 1/2009 | Cohen et al. |
| 2009/0036415 A1 | 2/2009 | Rubin et al. |
| 2009/0062144 A1 | 3/2009 | Guo |
| 2009/0075921 A1 | 3/2009 | Ikegawa |
| 2009/0149333 A1 | 6/2009 | Knudsen et al. |
| 2009/0191535 A1 | 7/2009 | Connelly et al. |
| 2009/0204333 A1 | 8/2009 | Friend et al. |
| 2009/0239221 A1 | 9/2009 | Chinnaiyan et al. |
| 2009/0280490 A1 | 11/2009 | Baker et al. |
| 2009/0298082 A1 | 12/2009 | Klee et al. |
| 2010/0021538 A1 | 1/2010 | Byun et al. |
| 2010/0055704 A1 | 3/2010 | Giordano et al. |
| 2010/0075384 A1 | 3/2010 | Kong et al. |
| 2010/0099093 A1 | 4/2010 | Weaver et al. |
| 2010/0131286 A1 | 5/2010 | Houlgatte et al. |
| 2010/0131432 A1 | 5/2010 | Kennedy et al. |
| 2010/0137164 A1 | 6/2010 | Rubin et al. |
| 2010/0178653 A1 | 7/2010 | Aharonov et al. |
| 2010/0215638 A1 | 8/2010 | Iljin et al. |
| 2010/0257617 A1 | 10/2010 | Arni et al. |
| 2010/0279327 A1 | 11/2010 | Ossovskaya |
| 2010/0285979 A1 | 11/2010 | Zeiger et al. |
| 2011/0009286 A1 | 1/2011 | Andre et al. |
| 2011/0045462 A1 | 2/2011 | Fu et al. |
| 2011/0092375 A1 | 4/2011 | Zamore et al. |
| 2011/0136683 A1 | 6/2011 | Davicioni |
| 2011/0152110 A1 | 6/2011 | Vierlinger et al. |
| 2011/0166838 A1 | 7/2011 | Gehrmann |
| 2011/0178163 A1 | 7/2011 | Chowdhury |
| 2011/0212855 A1 | 9/2011 | Rafnar et al. |
| 2011/0229894 A1 | 9/2011 | Levy et al. |
| 2011/0230372 A1 | 9/2011 | Willman et al. |
| 2011/0236903 A1 | 9/2011 | McClelland |
| 2011/0287946 A1 | 11/2011 | Gudmundsson et al. |
| 2011/0294123 A1 | 12/2011 | Nakamura et al. |
| 2011/0312520 A1 | 12/2011 | Kennedy et al. |
| 2012/0015839 A1 | 1/2012 | Chinnaiyan |
| 2012/0015843 A1 | 1/2012 | Von et al. |
| 2012/0041274 A1 | 2/2012 | Stone et al. |
| 2012/0108453 A1 | 5/2012 | Smit et al. |
| 2012/0115743 A1 | 5/2012 | Davicioni et al. |
| 2012/0122698 A1 | 5/2012 | Stacey et al. |
| 2012/0122718 A1 | 5/2012 | Reisman |
| 2012/0157334 A1 | 6/2012 | Beaudenon-Huibregtse et al. |
| 2012/0172243 A1 | 7/2012 | Davicioni et al. |
| 2012/0214165 A1 | 8/2012 | Walfish et al. |
| 2012/0220474 A1 | 8/2012 | Kennedy et al. |
| 2012/0304318 A1 | 11/2012 | Ohnuma et al. |
| 2013/0004974 A1 | 1/2013 | Klee et al. |
| 2013/0023434 A1 | 1/2013 | Van |
| 2013/0142728 A1 | 6/2013 | Beaudenon-Huibregtse et al. |
| 2013/0150257 A1 | 6/2013 | Abdueva et al. |
| 2013/0172203 A1 | 7/2013 | Yeatman et al. |
| 2013/0184999 A1 | 7/2013 | Ding |
| 2013/0196866 A1 | 8/2013 | Pestano et al. |
| 2013/0225662 A1 | 8/2013 | Kennedy et al. |
| 2013/0231258 A1 | 9/2013 | Wilde et al. |
| 2013/0273543 A1 | 10/2013 | Gudmundsson et al. |
| 2013/0302808 A1 | 11/2013 | Vasmatzis |
| 2013/0302810 A1 | 11/2013 | Latham et al. |
| 2013/0303826 A1 | 11/2013 | Jurisica et al. |
| 2014/0030714 A1 | 1/2014 | Paschke et al. |
| 2014/0080731 A1 | 3/2014 | Davicioni et al. |
| 2014/0087961 A1 | 3/2014 | Sulem et al. |
| 2014/0099261 A1 | 4/2014 | Keutgen et al. |
| 2014/0121126 A1 | 5/2014 | Bivona et al. |
| 2014/0143188 A1 | 5/2014 | Mackey et al. |
| 2014/0228237 A1 | 8/2014 | Kennedy et al. |
| 2014/0243240 A1 | 8/2014 | Soldin et al. |
| 2014/0302042 A1 | 10/2014 | Chin et al. |
| 2014/0303002 A1 | 10/2014 | Shak et al. |
| 2014/0303034 A1 | 10/2014 | Gascoyne et al. |
| 2014/0315199 A1 | 10/2014 | Rhodes et al. |
| 2014/0315739 A1 | 10/2014 | Aharonov et al. |
| 2014/0349856 A1 | 11/2014 | Schnabel et al. |
| 2014/0349864 A1 | 11/2014 | Kennedy et al. |
| 2014/0371096 A1 | 12/2014 | Umbright et al. |
| 2015/0038376 A1 | 2/2015 | Tian et al. |
| 2015/0099665 A1 | 4/2015 | Rosenfeld et al. |
| 2015/0141470 A1 | 5/2015 | Garraway et al. |
| 2015/0253331 A1 | 9/2015 | Zijlstra |
| 2015/0275306 A1 | 10/2015 | Bernards et al. |
| 2015/0292030 A1 | 10/2015 | McConkey |
| 2015/0299808 A1 | 10/2015 | Gonzalez et al. |
| 2015/0307947 A1 | 10/2015 | Basu et al. |
| 2015/0329915 A1 | 11/2015 | Davicioni et al. |
| 2015/0368724 A1 | 12/2015 | Aharonov et al. |
| 2016/0024586 A1 | 1/2016 | Delfour et al. |
| 2016/0032395 A1 | 2/2016 | Davicioni et al. |
| 2016/0032400 A1 | 2/2016 | Gomis et al. |
| 2016/0068915 A1 | 3/2016 | Kennedy et al. |
| 2016/0076108 A1 | 3/2016 | Davicioni et al. |
| 2016/0115546 A1 | 4/2016 | Rosenfeld et al. |
| 2016/0120832 A1 | 5/2016 | Rabinowitz et al. |
| 2016/0251729 A1 | 9/2016 | Chinnaiyan |
| 2016/0312294 A1 | 10/2016 | Walker |
| 2016/0312305 A1 | 10/2016 | Kennedy et al. |
| 2016/0312306 A1 | 10/2016 | Kennedy et al. |
| 2016/0312307 A1 | 10/2016 | Kennedy et al. |
| 2016/0312308 A1 | 10/2016 | Kennedy et al. |
| 2017/0016076 A1 | 1/2017 | Barnett-Itzhaki et al. |
| 2017/0145513 A1 | 5/2017 | Kennedy et al. |
| 2017/0166980 A1 | 6/2017 | Fahey, III et al. |
| 2017/0218455 A1 | 8/2017 | Steelman |
| 2017/0329894 A1 | 11/2017 | Kennedy et al. |
| 2018/0016642 A1 | 1/2018 | Kennedy et al. |
| 2018/0216197 A1 | 1/2018 | Davicioni et al. |
| 2018/0030540 A1 | 2/2018 | Davicioni et al. |
| 2018/0068058 A1 | 3/2018 | Abdueva et al. |
| 2018/0112275 A1 | 4/2018 | Davicioni et al. |
| 2018/0122508 A1 | 5/2018 | Wilde et al. |
| 2018/0127832 A1 | 5/2018 | Kennedy et al. |
| 2018/0282817 A1 | 10/2018 | You |
| 2018/0291459 A1 | 10/2018 | Al-Deen Ashab et al. |
| 2019/0204322 A1 | 7/2019 | Alshalalfa et al. |
| 2019/0218621 A1* | 7/2019 | Davicioni .............. G01N 33/48 |
| 2020/0165682 A1 | 5/2020 | Chinnaiyan et al. |
| 2020/0181710 A1 | 6/2020 | Steelman |
| 2020/0224276 A1 | 7/2020 | Chinnaiyan et al. |

(56) References Cited

U.S. PATENT DOCUMENTS

| | | |
|---|---|---|
| 2021/0130902 A1 | 5/2021 | Da Vicioni |
| 2021/0317531 A1 | 10/2021 | Da Vicioni |

FOREIGN PATENT DOCUMENTS

| | | |
|---|---|---|
| EP | 1 777 523 | 4/2007 |
| EP | 2 366 800 | 9/2011 |
| WO | WO 90/015070 | 12/1990 |
| WO | WO 92/010092 | 6/1992 |
| WO | WO 93/009668 | 5/1993 |
| WO | WO 93/022684 | 11/1993 |
| WO | WO 98/045420 | 10/1998 |
| WO | WO 01/060860 | 8/2001 |
| WO | WO 01/066753 | 9/2001 |
| WO | WO 02/000929 | 1/2002 |
| WO | WO 02/083921 | 10/2002 |
| WO | WO 03/012067 | 2/2003 |
| WO | WO 04/037972 | 5/2004 |
| WO | WO 05/040396 | 5/2005 |
| WO | WO 05/085471 | 9/2005 |
| WO | WO 05/100608 | 10/2005 |
| WO | WO 06/047484 | 5/2006 |
| WO | WO 06/091776 | 8/2006 |
| WO | WO 06/110264 | 10/2006 |
| WO | WO 06/127537 | 11/2006 |
| WO | WO 06/135596 | 12/2006 |
| WO | WO 07/056049 | 5/2007 |
| WO | WO 07/070621 | 6/2007 |
| WO | WO 07/081720 | 7/2007 |
| WO | WO 07/081740 | 7/2007 |
| WO | WO 08/023087 | 2/2008 |
| WO | WO 08/046911 | 4/2008 |
| WO | WO 08/086478 | 7/2008 |
| WO | WO 08/112283 | 9/2008 |
| WO | WO 09/009432 | 1/2009 |
| WO | WO 09/020521 | 2/2009 |
| WO | WO 09/020905 | 2/2009 |
| WO | WO 09/029266 | 3/2009 |
| WO | WO 09/045115 | 4/2009 |
| WO | WO 09/074968 | 6/2009 |
| WO | WO 09/108860 | 9/2009 |
| WO | WO 09/143603 | 12/2009 |
| WO | WO 10/018601 | 2/2010 |
| WO | WO 10/056374 | 5/2010 |
| WO | WO 10/073248 | 7/2010 |
| WO | WO 10/099598 | 9/2010 |
| WO | WO 10/123626 | 10/2010 |
| WO | WO 10/124372 | 11/2010 |
| WO | WO 11/150453 | 12/2011 |
| WO | WO 12/031008 | 3/2012 |
| WO | WO 12/068383 | 5/2012 |
| WO | WO 12/135008 | 10/2012 |
| WO | WO 13/006495 | 1/2013 |
| WO | WO 13/088457 | 6/2013 |
| WO | WO 13/116742 | 8/2013 |
| WO | WO 14/028884 | 2/2014 |
| WO | WO 14/043803 | 3/2014 |
| WO | WO 14/085666 | 5/2014 |
| WO | WO 14/151764 | 9/2014 |
| WO | WO 15/024942 | 2/2015 |
| WO | WO 15/071876 | 5/2015 |
| WO | WO 15/073949 | 5/2015 |
| WO | WO 16/141127 | 9/2016 |
| WO | WO 17/059549 | 4/2017 |
| WO | WO 17/062505 | 4/2017 |
| WO | WO 18/165600 | 9/2018 |
| WO | WO 19/023517 | 1/2019 |

OTHER PUBLICATIONS

Michiels et al. Prediction of cancer outcome with microarrays: a multiple random validation strategy (2005) Lancet 365:488-92 (Year: 2005).*

Nevins et al. Mining gene expression profiles: expression signatures as cancer phenotypes (2007) Genetics vol. 8, 601-609 (Year: 2007).*

Lockstone et al. EXon array data analysis using Affymetrix power tools and R statistical software (2010) Briefings in Bioinformatics vol. 12, No. 6, 634-644. (Year: 2010).*

Sparano et al. Prospective Validation of a 21-Gene Expression Assay in Breast Cancer (2055) New Eng. J. Med. 373:20 2005-2014. (Year: 2015).*

Forker et al. Biomarkers of Tumour Radiosensitivity and Predicting Benefit from Radiotherapy (2015) 27: 561-569. (Year: 2015).*

Zhang et al. 21-Gene Recurrence Score Assay Could Not Predict Benefit of Post-mastectomy Radiotherapy in T1-2 N1mic ER-Positive HER2 Negative Breast Cancer (2019) Frontiers in Oncology vol. 9, Issue 270, 11 pages. (Year: 2019).*

Abdueva et al., "Quantitative Expression Profiting in Formalin-Fixed Paraffin-Embedded Samples by Affymetrix Microarrays," Journal of Molecular Diagnostics (Jul. 2010) vol. 12, No. 4, pp. 409-417.

Adamo and Ladomery, "The Oncogene ERG: A Key Factor in Prostate Cancer," *Oncogene*(2016), 35:403-414.

Affymetrix GeneChip Human Genome U133 Array Set HG-U133A, Geo, Mar. 11, 2002, retrieved on Mar. 11, 2002.

Affymetrix: Data Sheet, "GeneChip® Exon Array System for Human, Mouse, and Rat," Internet Citation, [Online] Jan. 25, 2012 [Retrieved from the Internet] Intp://www.biainformatics.atickland.aciaz/workshops/1O_March_2011 1Exon_EOST_Datash eet.pdf, 8 pages.

Agell et al., "A 12-Gene Expression Signature Is Associated with Aggressive Histological in Prostate Cancer: SEC14L1 and TCEB1 Genes Are Potential Markers of Progression," Am J Pathol (2012) vol. 181 (5), pp. 1585-1594.

Alberts et al., "Vesicular traffic in the secretory and endocytic pathways," Molecular Biology of the Cell (1994) 3rd Ed., p. 465.

Aldred et al., "Papillary and follicular thyroid carcinomas show distinctly different microarray expression profiles and can be distinguished by a minimum of five genes," J Clin Oncol. (2004) 22(17):3531-9.

Amling et al.: "Long-term hazard of progression after radical prostatectomy for clinically EB localized prostate cancer continued risk of biochemical failure after 5 years," J Urol. (2000) 164:101-105.

Amundadottir et al., "A common variant associated with prostate cancer in European and African populations," Nat Genet. (2006) 38:652-658.

Amundson et al., "Integrating global gene expression and radiation survival parameters across the 60 cell lines of the National Cancer Institute Anticancer Drug Screen," Cancer Research (2008) 68(2):415-424.

Anonymous, UCSC Genome Browser on Human Mar. 2006, NCBI36/hg18) Assembly, Mar. 2006, XP055587638, Retrieved from the Internet: URL:https://genome-euro.ucsc.edu/cgi-bin/hgTracks?db=hg18&lastVirtModeType=default&lastVirtModeExtraState=&virtModeType=default&virtMode=0&nonVirtPosition=&position=chr5%3A 14025126%2D14062770&hgsid=232148223_IYIy9VS0Lh0jhldEBQ3nViBrQuB5 [retrieved on May 10, 2019].

Ateeq et al., Mar. 2, 2011, Therapeutic tareting of SPINK1-positive prostate cancer, Sci Transl Med, 3(72):1-18.

Ausubel, et al. Current Protocols in Molecular Biology. Wiley & Sons, New York (1995) Table of Contents.

Baetke et al., "Molecular Pathways Involved in Prostate Carcinogenesis: Insights from Public Microarray Datasets," PLoS One (2012) 7(11):e49831, 1-11.

Baggerly et al., "Deriving Chemosensitivity from Cell Lines: Forensic Bioinformatics and Reproducible Research in High-Throughput Biology," The Annals of Applied Sciences (2009) vol. 3, No. 4, pp. 1309-1334.

Ballman et al., "Faster cyclic loess: normalizing RNA arrays via linear models," Bioinformatics, 2004, 20 :2778-2786.

Bannert et al., "Retroelements and the human genome: new perspectives on an old relation." PNAS (Oct. 5, 2004) vol. 101, Suppl. 2, pp. 14572-14579.

(56) References Cited

OTHER PUBLICATIONS

Barlow et al., "Analysis of Case-Cohort Designs," J Clin Epidemiol (1999) vol. 52 (12), 1165-1172.
Bauer et al., "Identification of Markers of Taxane Sensitivity Using Proteomic and Genomic Analyses of Breast Tumor from Patients Receiving Neoadjuvant Paclitaxel and Radiation," Clin. Cancer Res. (2010) 16(2):681-690, American Association for Cancer Research.
Becht et al., Oct. 20, 2016, Estimating the popluation abundance of tissue-infiltraign immune and stromal cell populations using gene expression, Gemone Biology, 52(Suppl 2):218.
Benner et al., "Evolution, language and analogy in functional genomics," Trends in Genetics, (Jul. 2001) vol. 17, pp. 414-418.
Bergstralh et al., "Software for optimal matching in observation al studies," Epidemiology (1996) 7(3):331-332.
Best et al., "Molecular differentiation of high- and moderate-grade human prostate cancer by cDNA microarray analysis", Diagn Mol Pathol. (2003) 12(2):63-70.
Bhaskar et al., Oct. 1, 2003, E-selective up-regulation allows for targeted drug delivery in prostate cancer, Cancer Research 63:6387-6394.
Bibikova et al., "Expression signatures that correlated with Gleason score and relapse in prostate cancer," Genomics (2007) 89(6):666-672.
Bibikova et al., "Gene expression profiles in formalin-fixed, paraffin-embedded tissues obtained with a novel assay for microarray analysis," Clin Chem., 2004, 50:2384-2386.
Bibikova et al., "Quantitative gene expression profiling in formalin-fixed, paraffin-embedded tissues using universal bead airays," Am J Pathol. (2004) 165:1799-1807.
Birney et al., "Identification and analysis of functional elements in 1% of the human genome by the ENCODE pilot project." Nature Jun. 14, 2007; 447(7146):799-816.
Bismar et al., "ERG Protein Expression Reflects Hormonal Treatment Response and is Associated with Gleason Score and Prostate Cancer Specific Mortality," Eur. J. Cancer (2012), 48:538-546,Elsevier Ltd.
Biton et al., Nov. 20, 2014, Independent component analysis uncovers the landscape of the bladder tumor transcriptome and reveals insights into luminal and basal subtypes, Cell Reports, 9(4):1235-1245.
Blute et al., "Use of Gleason score, prostate specific antigen, seminal vesicle and margin status to predict biochemical failure after radical prostatectomy," J Urol (2001) 165: 119-125.
Boorjian et al., "Long-term risk of clinical progression after biochemical recurrence following radical prostatectomy: the impact of time from surgery to recurrence." Eur Urol. (Jun. 2011) 59(6):893-9.
Boormans et al., "Identification of TDRD1 as a direct target gene of ERG in primary prostate cancer," Int J Cancer (2013) vol. 133 (2), pp. 335-345.
Bostwick et al., "Prognostic factors in prostate cancer: College of American Pathologists consensus statement," Arch Pathol Lab Med (2000) 124(7):995-1000.
Bott et al., "Prostate cancer management: (2) an update on locally advanced and metastatic disease", Postgrad Med J, Dec. 3, 2003, 79(937), 643-645.
Brase et al., "TMPRSS2-ERG—specific transcriptional modulation is associated with prostate cancer biomarkers and TGF-β signaling," BMC Cancer (2011) 11(507):1-8.
Breiman, "Random Forests," Machine Learning (2001) 45:5-32.
Brouha et al., "Hot L1s account for the bulk of retrotransposition in the human population." PNAS USA (Apr. 29, 2003) 100(9):5280-5.
Bueno et al., "A diagnostic test for prostate cancer from gene expression profiling data," J Urol, Feb. 2004; 171(2 Pt 1):903-6.
Bull et al., "Identification of potential diagnostic markers of prostate cancer and prostatic intraepithelial neoplasia using cDNA microarray," British J Cancer (Jun. 1, 2001) 84(11):1512-1519.
Bussemakers et al., "DD3: a new prostate-specific gene, highly overexpressed in prostate cancer." Cancer Res. (Dec. 1, 1999) 59(23):5975-9.

Carninci et al., "The transcriptional landscape of the mammalian genome," Science (Sep. 2, 2005) 09(5740):1559-63.
Cerutti et al. "Diagnosis of suspicious thyroid nodules using four protein biomarkers," Clin Cancer Res. (2006) 12(11 Pt 1):3311-8.
Chalitchagorn et al., "Distinctive pattern of LINE-1 methylation level in normal tissues and the association with carcinogenesis." Oncogene (Nov. 18, 2004) 23(54):8841-6.
Che et al.: "Prognostic Value of Abnormal p53 Expression in Locally Advanced Prostate Cancer Treated With Androgen Deprivation and Radiotherapy: A Study Based on RTOG 9202"; International Journal of Radiation: Oncology Biology Physics (Nov. 15, 2007) vol. 69, No. 4, pp. 1117-1123.
Chen et al., "Deregulation of a Hox Protein Regulatory Network Spanning Prostate Cancer Initiation and Progression," Clin Cancer Res (Jun. 2012) 18(16):4291-4302.
Chen et al., "Hepsin and maspin are inversely expressed in laser capture microdissectioned prostate cancer," J Urol. (Apr. 2003) 169(4):1316-1319.
Chen et al., "Significance of noninvasive diagnosis of prostate cancer with cytologic examination of prostatic fluid," J Nippon Med Sch. (Jun. 2006) 73(3):129-135.
Chen et al.: "Molecular determinants of resistance to antiandrogen therapy"; Nature Medicine, Nature Publishing Group, New York, NY (Jan. 1, 2004) vol. 10, No. 1, pp. 33-39.
Cheng et al. "Cell Proliferation in Prostate Cancer Patients with Lymph Node Metastasis", Clin Cancer Res (Oct. 1999) 5(10): 2820-2823.
Cheung et al., "Natural variation in human gene expression assessed in lymphoblastoid cells," Nature Genetics (2003) vol. 33, pp. 422-425.
Cheville et at., "Gene Panel Model Predictive of Outcome in Men at High-Risk of Systemic Progression and Death From Prostate Cancer After Radical Retropubic Prostatectomy," Journal Of Clinical Oncology (Aug. 20, 2008) vol. 26 , No. 24.
Chifman et al., "Conservation of immune gene signatures in solid tumors and prognostic implications," BMC Cancer (2016) 16:911, pp. 1-17. DOI 10.1186/S12885-016-2948-Z.
Cho et al., "Hypermethylation of CpG island loci and hypomethylation of LINE-1 and Alu repeats in prostate adenocarcinoma and their relationship to clinicopathological features", J Pathol (Feb. 2007) 211(3):269-77.
Choi et al., Feb. 2014, Identification of distinct basal and luminal subtypes of muscle-invasive bladder cancer with different sensitivities to frontline chemotherapy, Cancer Cell, 25(2):152-165.
Choi et al., Jun. 24, 2014, Intrinsic basal and luminal subtypes of muscle-invasive bladder cancer, Nature Reviews Urology, 11(7):400-410.
Chow et al., "LINE-1 activity in facultative heterochromatin formation during X chromosome inactivation," Cell (Jun. 11, 2010) 141(6):956-69.
Cibas, et al. "The Bethesda System for Reporting Thyroid Cytopathology," Am J Clin Pathol. (Nov. 2009) 132(5):658-65. doi: 10.1309/AJCPPHLWMI3JV4LA.
Clancy et al., "Profiling networks of distinct immune-cells in tumors," BMC Bioinformatics (2016) 17:263, pp. 1-15. DOI 10.1186/s12859-016-1141-3.
Clark-Langone et al. "Biomarker discovery for colon cancer using a 761 gene RT-PCR assay 2007," BMC Genomics (2007) 8:279 pp. 1-18.
Cologne et al., "Optimal Case-Control Matching in Practice," Epidemiology Resources Inc. (1995) 6(3):271-275.
Cooper et al., "Mechanisms of Disease: biomarkers and molecular targets from microarray gene expression studies in prostate cancer ," Nat Clin Pract Urol. (2007) Dee:4(12):677-87.
Cooperberg et al., "The CAPRA-S score: A straightforward tool for improved prediction of outcomes after radical prostatectomy," Cancer (2011) vol. 117 (22), pp. 5039-5046.
Cordaux et al., "The impact of retrotransposons on human genome evolution." Nat Rev Genet. (Oct. 2009) 10(10):691-703.
Cordon-Cardo et al., "Improved prediction of prostate cancer recurrence through systems pathology," The Journal of Clinical Investigation (Jul. 2007) vol. 117, No. 7, pp. 1876-1883.

(56) References Cited

OTHER PUBLICATIONS

Couzin-Frankel, Jennifer, "As Questions Grow, Duke Halts Trials, Launches Investigation," Science (Aug. 6, 2010) vol. 329, pp. 614-615.

Cuzik et al., "Prognostic value of an RNA expression signature derived from cell cycle proliferation genes in patients with prostate cancer: a retrospective study," thelancet.com/oncology (Mar. 2011) vol. 12, pp. 245-255.

Dahlman et al., "Effect of androgen deprivation therapy on the expression of prostate cancer biomarkers MSMB and MSMB-binding protein CRISP3," Prostate Cancer and Prostatic Diseases (2010) 13:369-375.

Dalela et a., Jun. 20, 2017, Genomic classifier augments the role of pathological features in identifying optimal candidates for adjuvant radiation therapy in patients with prostate cancer: development and internal validation of a multivariable prognostic model, Journal of Clinical Oncology, 35(18):1982-1990.

Dalela et al., "Contemporary Role of the Decipher Test in Prostate Cancer Management: Current Practice and Future Perspectives," Rev. Urol. (2016), 18(1):1-9, MedReviews®, LLC.

Dalsgaard Sorensen et al.: "Discovery of prostate cancer biomarkers by microarray gene expression profiling"; Expert Review of Molecular Diagnostics, vol. 10, No. 1, Jan. 1, 2010, pp. 49-64.

D'Amico et al., "Cancer-specific mortality after surgery or radiation for patients with clinically localized prostate cancer managed during the prostate-specific antigen era," J Clin Oncol. (2003) 21:2163-2172.

D'Amico et al., "Determinants of prostate cancer-specific survival after radiation therapy for patients with clinically localized prostate cancer," J Clin Oncol. (2002) 20:4567-4573.

Damrauer et al., Feb. 25, 2014, Intrinsic subtypes of high-grade bladder cancer reflect the hallmarks of breast cancer biology, Proc Natl Acad Sci USA, 111(8):3110-3115.

Dawood, Shaheenah, "Novel Biomarkers of Metastatic Cancer," Expert Rev. Mo/. Diagn. (2010) 10(5):581-590, Expert Reviews Ltd.

Day et al., "Estimating enrichment of repetitive elements from high-throughput sequence data." Genome Biol. (2010) 11 (6):R69.

De Klein et al., "A cellular oncogene is translocated to the Philadelphia chromosome in chronic myelocytic leukaemia." Nature (Dec. 23, 1982) 300(5894):765-7.

De Marzo et al., "Pathological and molecular mechanisms of prostate carcinogenesis: implications for diagnosis, detection, prevention, and treatment," J Cell Biochem. (Feb. 15, 2004) 91(3):459-477.

Dechassa et al., "Architecture of the SWI/SNF-nucleosome complex," Mol Cell Biol. (Oct. 2008) vol. 28, No. 19, pp. 6010-6021.

Demichelis et al., "TMPRSS2:ERG gene fusion associated with lethal prostate cancer in a watchful waiting cohort," Oncogene (2007) 26:4596-4599.

Den et al., Mar. 10, 2015, Genomic classifier identifies men with adverse pathology after racial prostatectomy who benefit from adjuvant radiation therapy, Journal of Clinical Oncology, 33(8):944-951.

Dhanasekaran et al., "Delineation of prognostic biomarkers in prostate cancer," Nature (2001) 412:822-826.

Dhani et al., 2011, Phase II study of cytarabine in men with docetaxel-refractory, castration-resistnt prostate cancer with evaluation of TMPRSS2-ERG and SPINK1 as serum biomarkers, BJUI, 110:840-845.

Dougherty, "The fundamental role of pattern recognition for gene-expression/microarray data in bioinformatics," Pattern recognition (2005) 38:2226-2228.

Eder et al., "Genes differentially expressed in prostate cancer," BJU Int. (May 2004) 93(8): 1151-1155.

Edwards et al., "Expression analysis onto microarrays of randomly selected cDNA clones highlights HOXB13 as a marker of human prostate cancer," Br J Cancer. (Jan. 31, 2005) 92(2):376-381.

Edwards et al.: "MicroRNAs and Ultraconserved Genes as Diagnostic Markers and Therapeutic Targets in Cancer and Cardiovascular Diseases", Journal of Cardiovascular Translational Research (May 5, 2010) vol. 3, No. 3, pp. 271-279.

Englisch, et al., "Chemically Modified Oligonucleotides as Probes and Inhibitors," Angew. Chem. Int. Ed. Eng. (1991) 30:613-629.

Epstein et al., "Prognostic factors and reporting of prostate carcinoma in radical AU prostatectomy and pelvic lymphadenectomy specimens," Scand. J. Urol. Nephrol. Suppl. (2005) 216:34-63.

Erho et al., "Discovery and Validation of a Prostate Cancer Genomic Classifier that Predicts Early Metastasis Following Radical Prostatectomy," PLoS One (2013) 8(6):e66855, 1-12.

Ernst et al., "Decrease and gain of gene expression are equally discriminatory markers for prostate carcinoma: a gene expression analysis on total and microdissected prostate tissue," Am J Pathol. (Jun. 2002) 160(6):2169-2180.

Etzioni et al. "The case for early detection", Nature Reviews | Cancer (Apr. 2003) vol. 3, pp. 1-10.

Fan et al., "Concordance among gene-expression-based predictors for breast cancer," N Engl J Med. (2006) 355:560-569.

Feng et al., "Luminal and basal subtyping of prostate cancer," *J Clin Oncol* (Feb. 20, 2017) 35(6).

Feroze-Merzoug et al., "Molecular profiling in prostate cancer," Cancer Metastasis Rev. 1 (2001) 20(3-4):165-71.

Fine et al., "A Proportional Hazards Model for the Subdistribution of a Competing Risk," Journal of the American Statistical Association (1999) vol. 94 (446), pp. 496-509.

Finley et al., "Advancing the molecular diagnosis of thyroid nodules: defining benign lesions by molecular profiling," Thyroid (2005) 15(6):562-8.

Finley et al., "Discrimination of benign and malignant thyroid nodules by molecular profiling," Ann Surg. (2004) 240(3):425-36; discussion 436-7.

Fodor et al., "Light-directed, spatially addressable parallel chemical synthesis," Science (Feb. 15, 1991) 251(4995):767-773.

Foley et al., "Molecular pathology of prostate cancer: the key to identifying new biomarkers of disease," Endocrine-Related Cancer (2004) 11:477-488.

Fontaine, et al., "Increasing the number of thyroid lesions classes in microarray analysis improves the relevance of diagnostic markers," PLoS One (Oct. 29, 2009) 4(10):e7632. doi: 10.1371/journal.pone.0007632.

Fryknas et al., "Molecular markers for discrimination of benign and malignant follicular thyroid tumors," Tumour Biol. (2006) 27(4):211-20.

Fu et al., "Regulation of apoptosis by a prostate-specific and prostate cancer-associated noncoding gene, PCGEM1." DNA Cell Biol. (Mar. 2006) 25(3): 135-41.

Fujarewicz et al., "A multi-gene approach to differentiate papillary thyroid carcinoma from benign lesions: gene selection using support vector machines with bootstrapping," Endocr Relat Cancer (Sep. 2007) 14(3):809-26.

Gait. Chapter 16: Oligoribonucleotides. Antisense Research and Applications, Crooke and Lebleu Eds., CRC Press (1993) pp. 289-302.

Galamb et al., "Diagnostic mRNA Expression Patterns of Inflamed, Benign, and Malignant Colorectal Biopsy Specimen and their Correlation with Peripheral Blood Results," Cancer Epidemiology, Biomarkers & Prevention (Oct. 2008) 17(10):2835-2845.

Galavotti et al., Apr. 2012, The autophagy-associated factors DRAM1 and p62 regulate cell migration and invasion in glioblastoma stem cells, Oncogene, 32:699-712.

Gao et al. 2019, DeepCC: a novel deep learning-based framework for cancer molecular subtype classification. Oncogenesis, 8(44):1-12.

Gao et al., "VISTA is an inhibitory immune checkpoint that is increased after ipilimumab therapy in patients with prostate cancer," Nat Med. (May 2017) 23(5):551-555.

Garber et al., "Diversity of gene expression in adenocarcinoma of the lung," PNAS (Nov. 20, 2001) vol. 98, No. 24, pp. 13784-13789.

Genevieve de Saint Basile et al., "Severe Combined Immunodeficiency Caused By Deficiency In Either The Ii Or the E Subunit Of CD3," Journal of Clinical Investigation (2004) vol. 114, No. 10. p. 1512-1517.

(56) References Cited

OTHER PUBLICATIONS

Gentles et al., Jul. 20, 2015, The prognostic landscape of genes and infiltrating immune cells across human cancers, Nature Medicine, 21(8):938-945.
Gibb et al., "The functional role of long non-coding RNA in human carcinomas", Molecular Cancer, Biomed Central, London, GB (Apr. 13, 2011) vol. 10, No. 1, p. 38.
Giordano et al., "Organ-Specific Molecular Classification of Primary Lung, Colon, and Ovarian Adenocarcinomas Using Gene Expression Profiles," Am J Pathol (2001) 159(4):1231-1238.
Gleason: "Histologic grading and clinical staging of prostatic carcinoma", Urologic pathology: the prostate, (Tannenbaum, ed.) (1977) Lea & Febiger, Philadelphia, PA, pp. 171-197.
Gleason: "Histologic grading of prostate cancer: a perspective"; Hum. Pathol. (1992) 23(3):273-279.
Gleave et al., "Randomized comparative study of 3 versus 8-month neoadjuvant hormonal therapy before radical prostatectomy : biochemical and pathological effects," J Urol. (2001) 166:500-507.
Glinsky et al., "Gene expression profiling predicts clinical outcome of prostate cancer," J Clin Investigation (2004) 113(6):913-923.
Glinsky et al., "Microarray analysis identifies a death-from-cancer signature predicting therapy i failure in patients with multiple types of cancer," J Clin Invest. (2005) 115: 1503-1521.
Gonzalgo et al: "Molecular pathways to prostate cancer"; J Urol. (2003) 170(6 Pt 1):2444-2452.
Gore et al., Aug. 1, 2017, Decipher test impacts decision making among patients considering adjuvant and salvage treatment after radical prostatectomy: interim results from the multicenter prospective PRO-IMPACT study, Cancer, pp. 2850-2959.
Grambsch et al., "Proportional Hazards Tests and Diagnostics Based on Weighted Residuals," Biometrika (2013) vol. 81 (3), pp. 515-526.
Greenbaum et al.: "Comparing protein abundance and mRNA expression levels on a genomic scale"; Genome Biology (2003) 4(9):117.1-117.8.
Griffith et al., "Meta-analysis and meta-review of thyroid cancer gene expression profiling studies identifies important diagnostic biomarkers," J Clin Oncol. (2006) 24(31):5043-51.
Griffith, et al. Biomarker panel diagnosis of thyroid cancer: a critical review. Expert Rev Anticancer Ther. (Sep. 2008) 8(9):1399-413. doi: 10.1586/14737140.8.9.1399.
Gupta et al., "Long non-coding RNA HOTAIR reprograms chromatin state to promote cancer metastasis," Nature (Apr. 15, 2010) 464(7291): 1071-6.
Guttman et al., "Ab initio reconstruction of transcriptomes of pluripotent and lineage committed cells reveals gene structures of thousands of lincRNAs," Nat Biotechnol. (May 2010) 28(5):503-10.
Guttman et al., "Chromatin signature reveals over a thousand highly conserved large non-coding RNAs in mammals", Nature (Mar. 12, 2009) 458(7235):223-7.
Ha et al., Nov. 12, 2009, Comparison of affymetrix gene array with the exon array shows potential application for detection of transcript isoform variation, BMC Genomics, 19(1):519.
Haiman et al.: "Multiple regions within 8q24 independently affect risk for prostate cancer"; Nat Genet. (2007) 39:638-644.
Hamada et al., "Diagnostic usefulness of PCR profiling of the differentially expressed marker genes in thyroid papillary carcinomas," Cancer Lett. (Jun. 28, 2005) 224(2):289-301. Epub Nov. 18, 2004.
He et al., "The antisense transcriptomes of human cells", Science (Dec. 19, 2008) 322(5909): 1855-7.
Heagerty et al., "Time-Dependent ROC Curves for Censored Survival Data and a Diagnostic Marker," Biometrics (2000) vol. 56 (2), pp. 337-344.
Heemers, H. V. et al.: "Identification of a Clinically Relevant Androgen-Dependent Gene Signature in Prostate Cancer"; Cancer Research, vol. 71, No. 5 (2011) pp. 1978-1988.

Heidenreich et al., "EAU Guidelines on Prostate Cancer. Part 1: Screening, Diagnosis, and Treatment of Clinically Localised Disease," European Urology (2011) vol. 59, pp. 61-71.
Henrotin et al.: "Type II collagen peptides for measuring cartilage degradation," Biorheology (2004) 41 (3-4): Abstract.
Henshall et al., "Survival Analysis of Genome-Wide Gene Expression Profiles of Prostate cancers Identifies New Prognostic Targets of Disease Relapse," Cancer Research (Jul. 15, 2003) 63, 14196-4203.
Holzbeierlein et al., "Gene expression analysis of human prostate carcinoma during hormonal therapy identifies androgen-responsive genes and mechanisms of therapy resistance," Am. J . Pathol. (Jan. 2004) 164(1):217-227.
Hornberger et al., "A Multigene Prognostic Assay for Selection of Adjuvant Chemotherapy in Patients with T3, Stage II Colon Cancer: Impact on Quality-Adjusted Life Expectancy and Costs," Value In Health 15 (2012) pp. 1014-1021.
Huarte et al., "Large non-coding RNAs: missing links in cancer?" Human Molecular Genetics (Oct. 15, 2010) 19(2): R152- R161.
Hughes et al., "Molecular pathology of prostate cancer," J Clin Pathol. (Jul. 2005) 58(7):673-684.
Hughes et al., "Topoisomerase II—a expression increases with increasing Gleason score and with hormone insensitivity in prostate carcinoma," J Clin Pathol. (Jul. 2006) 59(7): 721-724.
Humphrey et al: "Histologic grade, DNA ploidy, and intraglandular tumor extent as indicators of tumor progression of clinical Stage B prostatic carcinoma"; Am J Surg Pathol (1991) 15(12):1165-1170.
Ida et al., "Topoisomerase II alpha protein expression Is predictive of outcome in Gleason score 7 prostate cancer patients treated surgically and is dependent on ERG status." Mod Pathol. (Feb. 2010) Abstract 1895, 23 : 424A-425A.
Inamura, Apr. 2018, Bladder Cancer: new insights into its molecular pathology, Cancers (Basel), 10(4):100.
Ito et al., "Linkage of elevated ets-2 expression to hepatocarcinogenesis," Anticancer Research (2002) 22(4):2385-2389.
Jemal et al.: "Cancer statistics," CA Cancer J Clin. (2005) 55:10-30.
Jenkins et al., "Prognostic significance of ailetic imbalance of chromosome arms 71, 8p, 16q, and 18q in stage T3NOMO prostate cancer," Genes, Chromosomes & Cancer (1998) 21:131-143.
Jhavar et al., "Integration of ERG gene mapping and gene-expression profiling identifies distinct categories of human prostate cancer," BJUI (2008) vol. 103 (9), pp. 1256-1269.
Jhavar et al., "Technical Advance: Detection of TMPRSS2-ERG Translocations in Human Prostate Cancer by Expression Profiling Using GeneChip Human Exon 1.0 ST Arrays," J Mol. Diag (Jan. 2008) vol. 10, No. 1, pp. 50-57.
Jones et al., "Frequent mutations of chromatin remodeling gene ARID1A in ovarian clear cell carcinoma" Science (Oct. 8, 2010) 330(6001):228-31.
Kanehisa, "Use of statistical criteria for screening potential homologies in nucleic acid sequences," Nucleic Acids Res. (Jan. 11, 1984) 12(1 Pt 1):203-13.
Karan et al., "Current status of the molecular genetics of human prostatic adenocarcinomas," Int J Cancer, 2003, 103(3):285-293.
Karayi et al., "Molecular biology of prostate cancer," Prostate Cancer Prostatic Dis. (2004) 7(1):6-20.
Karnes et al., "Radical prostatectomy for high-risk prostate cancer," Jpn. J. Clin. Oneal. (Oct. 19, 2009) 40(1): 3-9, Epub.
Karnes et al., "The ability of biomarkers to predict systemic progression in men with high-risk prostate cancer treated surgically is dependent on ERG status," Cancer Res. (Nov. 9, 2010) 70(22):8994-9002, Epub.
Kasraeian, et al. , "A comparison of fine-needle aspiration, core biopsy, and surgical biopsy in the diagnosis of extremity soft tissue masses," Clin Orthop Relat Res. (Nov. 2010) 468(11):2992-3002.
Kawamorita et al., "Radical prostatectomy for high-risk prostate cancer: Biochemical outcome," International Journal of Urology (2009) 16:733-738.
Kebebew et al., "Diagnostic and extent of disease multigene assay for malignant thyroid neoplasms," Cancer (2006) 106(12):2592-7.
Kelly et al., 2012, Agreement in Risk Prediction Between the 21-Gene Recurrence Score Assay (Oncotype DX) and the PAM50

(56) References Cited

OTHER PUBLICATIONS

Breast Cancer Intrinsic Classifier™ in Early-Stage Estrogen Receptor-Positive Breast Cancer, The Oncologist, 17:492-498.
Kestin, "Potential survival advantage with early androgen deprivation for biochemical failure after external beam radiotherapy: the importance of accurately defining biochemical disease status," Int J Rad Oncol Biol Phys. (2004) 60:453-62.
Khor et al.: "Bcl-2 and Bax Expression Predict Prostate Cancer Outcome in Men Treated with Androgen Deprivation and Radiotherapy on Radiation Therapy Oncology Group Protocol 92-02"; Clinical Cancer Research (Jun. 15, 2007) vol. 13, No. 12, pp. 3585-3590.
Kiessling, et al., "D-TMPP: A novel androgen-regulated gene preferentially expressed in prostate and prostate cancer that is the first characterized member of an eukaryotic gene family," The Prostate (2005) 64:387-400.
Kikuchi et al., "Expression profiles of non-small cell lung cancers on cDNA microarrays: identification of genes for prediction of lymph-node metastasis and sensitivity to anti-cancer drugs," Oncogene (2003) 22, pp. 2192-2205.
Kishi et al., "Expression of the surviving gene in prostate cancer: correlation with clinicopathological characteristics, proliferative activity and apoptosis," J Urol. (May 2004) 171(5): 1855-1860.
Klee et al., "Candidate Serum Biomarkers for Prostate Adenocarcinoma identified by mRNA Differences in Prostate Tissue and Verified with Protein Measurements in Tissue and Blood," Clinical Chemistry (2012) 58(3):599-609.
Knowles et al., Dec. 23, 2014, Molecular biology of bladder cancer: new insights into pathogenesis and clinical diversity, Nature Reviews Cancer, 15(1):25-41.
Kosari et al., "Identification of biomarkers for prostate cancer," Clin. Cancer Res. (2008) 1734-1743.
Koshkin et al., "LNA (locked nucleic acids): An RNA mimic forming exceedingly stable LNA," LNA duplexes. J Am Chem Soc (1998) 120:13252-13253.
Koshkin et al., "LNA (locked nucleic acids): synthesis of the adenine, cytosine, guanine 5-methylcytosine, thymine and uracil bicyclonucleoside monomers, oligomerisation, and unprecedented nucleic acid recognition," Tetrahedron (1998) 54(14):3607-3630.
Kronick, 2004, Creation of the whole human genome microarray, Expert Review of Proteomics, 1:19-28.
Kroschwitz The Concise Encyclopedia Of Polymer Science And Engineering (1990) (pp. 858-859).
Kube et al., "Optimization of laser capture microdissection and RNA amplification for gene expression profiling of prostate cancer," BMC Mol. Biol. (2007) 8:25.
Kumar, et al., "The first analogues of LNA (locked nucleic acids): phosphorothioate-LNA and 2'-thio-LNA," Bioorg Med Chem Lett. (Aug. 18, 1998) 8(16):2219-22.
Kumar-Sinha et al., "Molecular markers to identify patients al risk for recurrence after primary treatment for prostate cancer," Urology, 62 Suppl 1:19-35, Dec. 29, 2003.
Kunarso et al., "Transposable elements have rewired the core regulatory network of human embryonic stem cells," Nat Genet (Jul. 2010) 42(7):631-4.
Landers et al.: "Use of multiple biomarkers for a molecular diagnosis of prostate cancer"; Int. J. Cancer (May 10, 2005) 114 pp. 950-956.
Lapointe et al., "Gene expression profiling identifies clinically relevant subtypes of prostate cancer," PNAS USA (2004) 101:811-816.
Latulippe et al., "Comprehensive Gene Expression Analysis of Prostate Cancer Reveals Distinct Transcriptional Programs Associated with Metastatic Disease," Cancer Res. (2002) 62:4499-4506.
Lawton et al., "Updated results of the phase III Radiation Therapy Oncology Group (RTOG) trial 85-31 evaluating the potential benefit of androgen suppression following standard radiation therapy for unfavorable prognosis carcinoma of the prostate," Int J Rad Oncol Biol Phys. (2001) 49:937-946.

Leyten et al., "Identification of a Candidate Gene Panel for the Early Diagnosis of Prostate Cancer," Clinical Cancer Research (2015) 21(13):3061-3070.
Lin et al., "Cox Regression with Incomplete Covariate Measurements," Journal of the American Statistical Association (1993) vol. 88 (424), pp. 1341-1349.
Lin et al., "Nuclear receptor-induced chromosomal proximity and DNA breaks underlie specific translocations in cancer," Cell (Dec. 11, 2009) 139(6):1069-83.
Liong et al., "Blood-Based Biomarkers of Aggressive Prostate Cancer," PLoS One (Sep. 2012) vol. 7, Issue 7, e45802, pp. 1-7.
Liu et al., 2014, Synergistic killing of lung cancer cells by cisplatin and radiation via autophagy and apoptosis, Oncology Letters, 7:1903-1910.
Livingston et al., "*Homo sapiens* CDC20 Cell Division Cycle 20 Homolog (CDC20)," Gene (Apr. 24, 2006).
Lockstone, "Exon array data analysis using Affymetrix power tools and R statistical software," Briefings in bioinformatics (2011) vol. 12 (6), pp. 634-644.
Lunardi et al., "A co-clinical approach identified mechanisms and potential therapies for androgen deprivation resistance in prostate cancer," Nature Genetics (Jul. 2013) vol. 45, No. 7, pp. 747-757.
Luo et al., "Gene expression analysis of prostate cancers," Molecular Carcinogenesis (Jan. 2002) 33(1):25-35.
Luo et al., "Human Prostate Cancer and Benign Prostatic Hyperplasia : Molecular Dissection by Gene Expression Profiling," Cancer Res. (2001) 61:4683-4688.
Magee et al., "Expression Profiling Reveals Hepsin Overexpression in Prostate Cancer," Cancer Res. (2001) 61:5692-5696.
Martens-Uzunova, E. S. et al.: "Diagnostic and prognostic signatures from the small non-coding RNA transcriptome in prostate cancer", Oncogene (Jul. 18, 2011) vol. 31, No. 8, pp. 978-991.
Martin, "A New Access to 2'-O-Alkylated Ribonucleosides and Properties of 2'-O-Alkylated Oligoribonucleotides," Helv. Chim. Acta. (1995) 78:486-504. (in German with English abstract).
Mazzanti, et al., "Using gene expression profiling to differentiate benign versus malignant thyroid tumors," Cancer Res. (Apr. 15, 2004) 64(8):2898-903.
McCall et al., "Frozen robust multiarray analysis (fRMA)", Biostatistics (2010) vol. 11 (2), 242-253.
McConkey et al., Apr. 2015, Therapeutic opportunities in the intrinsic subtypes of muscle-invasive bladder cancer, Hematology/Oncology Clinics of North America, 29(2):377-394.
McConkey et al., May 2016, A prognostic gene expression signature in the molecular classification of chemotherapy-naïve urothelial cancer is predictive of clinical outcomes from neoadjuvant chemotherapy: a phase 2 trial of dose-dense methotrexate, vinblastine, doxorubicin, and cisplatin with bevacizumab in urothelial cancer, European Urology, 69(5):855-862.
Mendiratta et al., "Genomic signatures associated with the development, progression, rand outcome of prostate cancer," Molecular diagnosis & therapy (2007) 11(6):345-54.
Mercer, DW, "Use of multiple markers to enhance clinical utility", Immunol Ser. (1990) 53: 39-54.
Mineva et al., "Differential expression of alphaB-crystallin and Hsp27-1 in anaplastic thyroid carcinomas because of tumor-specific alphaB-crystallin gene (CRYAB) silencing," Cell Stress Chaperones (Autumn 2005) 10(3):171-84.
Mitelman, "Recurrent chromosome aberrations in cancer," Mutation Research (2000) 462: 247-253.
Montironi et al., "Carcinoma of the prostate: inherited susceptibility, somatic gene defects and androgen receptors," Virchows Arch. (Jun. 2004) 444(6):503-508.
Moul et al., "Early versus delayed hormonal therapy for prostate specific antigen only recurrence of prostate cancer after radical prostatectomy," J Urol. (2004) 171:1141-1147.
Moul, "Prostate specific antigen only progression of prostate cancer," J Urol. (2000) 163:1632-42.
Mühlenbruch et al., "Multiple imputation was a valid approach to estimate absolute risk from a prediction model based on case—cohort data," Journal of Clinical Epidemiology (2017) 84:130-141.

(56) References Cited

OTHER PUBLICATIONS

Nakagawa et al., "A Tissue Biomarker Panel Predicting Systemic Progression after PSA Recurrence Post-Definitive Prostate Cancer Therapy," PLos One (2008) 3(5):e2318, 14 pages.
Nelson, "Predicting prostate cancer behavior using transcript profiles," J Urol. (Nov. 2004) 172(5 Pt 2):S28-32; discussion S33.
Newson, Roger, "Confidence intervals for rank statistics: Somers' D and extensions," The Stata Journal (Sep. 2006) 6(3):309-334.
Nielsen et al., "Sequence-selective recognition of DNA by strand displacement with a thymine-substituted polyamide," Science (1991) 254: 1497-1500.
Noordzij et al. "The prognostic value of CD44 isoforms in prostate cancer patients treated by radical prostatectomy", Ciin Cancer Res (May 1997) 3(5): 805-815.
Norman, James, "Thyroid Nodule Ultrasound", Endocrine website (Updated Oct. 13, 2010) http://www.endocrineweb.com/noduleus.html.
Ohl et al., "Gene expression studies in prostate cancer tissue: which reference gene should be selected for normalization?," J. Mol. Med . (2005) 83(12):1014-1024.
Ong et al., "Expression Profiling Identifies a Novel-Methylacyl-CoA Racemase Exon with Fumarate Hydratase Homology," Cancer Research (Jun. 15, 2003) 63:3296-3301.
Oosumi et al., "Mariner transposons in humans", Nature (Dec. 14, 1995) 378 (6558): 672.
Ozen et al., Sep. 24, 2007, Widespread deregulation of microRNA expression in human prostate cancer, Oncogene, 27:1788-1793.
Parker et al., "High expression levels of surviving protein independently predict a poor outcome for patients who undergo surgery for clear cell renal cell carcinoma," Cancer (2006) 107:37-45.
Parker et al., Mar. 10, 2009, Supervised risk predictor of breast cancer based on intrinsic subtypes, Journal of Clinical Oncology, 27(8):1160-1167 with appendix Figure A3.
Pascal et al., "Correlation of mRNA and protein levels: Cell type-specific gene expression of cluster designation antigens in the prostate," BMC Genomics (2008) 9:246 (13 pages).
Patel et al., "Preoperative PSA velocity is an independent prognostic factor for relapse after radical prostatectomy," J Clin Oncol. (2005) 23:6157-6162.
Paulo et al., "Molecular Subtyping of Primary Prostate Cancer Reveals Specific and Shared Target Genes of Different ETS Rearrangements," Neoplasia (Jul. 2012) 14(7):600-611.
Penney et al., "mRNA Expression Signature of Gleason Grade Predicts Lethal Prostate Cancer," J Clin Oncol (Jun. 10, 2011) vol. 29, No. 17, pp. 2391-2396 and Appendix.
Pereira et al., "Coagulation factor V and VIIIN ratio as predictors of outcome in paracetamol induced fulminant hepatic failure: relation to other prognostic indicators," Gut (1992) 33:98-102.
Perez et al., "Long, abundantly expressed non-coding transcripts are altered in cancer," Human Molecular Genetics (2008) vol. 17, No. 5, pp. 642-655. Published online Nov. 15, 207.
Pienta et al. "The current state of preclinical prostate cancer animal models"; Prostate (2008) 69:629-639.
Pilepich et al., "Phase III radiation therapy oncology group (RTOG) trial 86-10 of androgen deprivation adjuvant to definitive radiotherapy in locally advanced carcinoma of the prostate," Int. J. Radiation Oncology Biol. Phys. (2001) vol. 50, No. 5, pp. 1243-1252.
Pinover et al., "Validation of a treatment policy for patients with prostate specific antigen failure after three-dimensional conformal prostate radiation therapy," Cancer (Feb. 15, 2003) vol. 97, No. 4, pp. 1127-1133.
Pittoni et al., "The Dark Side of Mast Cell-Targeted Therapy in Prostate Cancer," Cancer Res. (2012) 72(4):831-835.
Porkka et al., "RAD21 and KIAA0196 at 8q24 are amplified and overexpressed in prostate cancer," Genes Chromosomes Cancer (2007) 39:1-10.
Porkka et al: "Molecular mechanisms of prostate cancer"; Eur Urol. (2004) 45(6):683-691.

Pound et al., "Natural history of progression after PSA elevation following radical prostatectomy," JAMA (1999) 281:1591-1597.
Prasad et al., "Identification of genes differentially expressed in benign versus malignant thyroid tumors," Clin Cancer Res. (2008) 14(11):3327-37.
Prat et al. 2012, PAM50 assay and the three-gene model for identifying the major and clinically relevant molecular subtypes of breast cancer. Breast Cancer Res Treat, 135:301-306.
Prensner et al., "Transcriptome Sequencing Identifies PCAT-1, a Novel lincRNA Implicated in Prostate Cancer Progression," (2012) 29 (8): 742-749.
Probe Set Listing for the Affymetrix Human Genome U133 Plus 2.0 array (Accessed from https://www.affymetrix.com/analysis/index.affx on Jul. 1, 2015) (Year: 2015).
Puskas, et al., "Gene profiling identifies genes specific for well-differentiated epithelial thyroid tumors," Cell Mol Biol (Noisy-le-grand) (Sep. 5, 2005) 51(2):177-86.
Rabbits, "Chromosomal translocations in human cancer", Nature (Nov. 10, 1994) 372: 143-149.
Reddy et al., "Clinical utility of microarray-derived genetic signatures in predicting outcomes in prostate cancer," Clinical Genitourinary Cancer (2006) 5(3):187-189.
Reis et al., "Antisense intronic non-coding RNA levels correlate to the degree of tumor differentiation in prostate cancer," Oncogene (2004) 23(39):6684-6692.
Rhodes et al., "Large-scale meta-analysis of cancer microarray data identifies common transcriptional profiles of neoplastic transformation and progression," Proc Nat Acad Sci USA (2004) 101:9309-9314.
Rhodes et al., "Multiplex biomarker approach for determining risk of prostate specific antigen-defined recurrence of prostate cancer," J Nat Cancer Inst. (May 7, 2003) vol. 95, No. 9, pp. 661-668.
Rhodes et al., "Oncomine: A Cancer Microarray Database and Integrated Data-Mining Platform," Neoplasia (2004) 6:1-6.
Rinn et al., "Functional demarcation of active and silent chromatin domains in human HOX loci by noncoding RNAs," Cell (Jun. 29, 2007) 129(7):1311-23.
Roberts et al., "The SWI/SNF complex-chromatin and cancer." Nat Rev Cancer (Feb. 2004) 4(2):133-42.
Robertson et al., "DNA in radical prostatectomy specimens. Prognostic value of tumor ploidy," Acta Oncologica (1991) 30(2):205-207.
Robertson et al., "Reconstructing the ancient mariners of humans." Nat Genet. (Apr. 1996) 12(4):360-1.
Robinson et al., "A dynamic programming approach for the alignment of signal peaks in multiple gas chromatography-mass spectrometry experiments," BMC Bioinformatics (2007) 8.1:419.
Robinson, et al., "A comparison of Affymetrix gene expression arrays," BMC Bioinformatics (Nov. 15, 2007) 8:449.
Romanuik et al., "LNCaP Atlas: Gene expression associated with in vivo progression to castration-recurrent prostate cancer," GMB Medical Genomics (2010) 3:43, pp. 1-19.
Ross et al., "Tissue-based Genomics Augments Post-prostatectomy Risk Stratification in a Natural History Cohort of Intermediate- and High-Risk Men," European Urology 69 (2016) pp. 157-165.
Rotblat et al., "A Possible Role for Long Non-Coding RNA in Modulating Signaling Pathways," Med. Hvnotheses (2011) 77:962-965, Elsevier.
Rotunno et al., "A Gene Expression Signature from Peripheral Whole Blood for Stage I Lung Adenocarcinoma," Cancer Prevention Research (Jul. 8, 2011) 4(10) 1599-1607.
Rowley, "A new Consistent Chromosomal Abnormal ity in Chronic Myelogenous Leukaemia identified by Quinacrine fluorescence and Giemsa Staining," Nature (Jun. 1, 1973) 243:290-293.
Rowley, "Chromosome translocations: dangerous liaisons revisited," Nature Reviews: Cancer (Dec. 2001) 1):245-250.
Rubin et al., "Molecular genetics of human prostate cancer," Modern Pathol. (2004) 17(3):380-388.
Saito-Hisaminato et al., "Genome-Wide Profiling of Gene Expression in 29 Normal Human Tissues with a cDNA Microarray," DNA Research (2002) vol. 9, pp. 35-45.

(56) References Cited

OTHER PUBLICATIONS

Saligan et al., "Supervised Classification by Filter Methods and Recursive Feature Elimination Predicts Rick of Radiotherapy-Related Fatigue in Patients with Prostate Cancer," Cancer Informatics (2014) 13: 141-152.
Sandler et al., "Overall survival after prostate-specific-antigen-detected recurrence following conformal radiation therapy," Int J Rad Oncol Biol Phys. (2000) 48:629-633.
Sanghvi, "Heterocyclic base modifications in nucleic acids and their applications in antisense oligonucleotides in Antisense Research and Applications," Crooke, S. T. and Lebleu, B., ed., CRC Press. (1993) Ch 15 274-285.
Saramaki et al., "Amplification of EIF3S3 gene is associated with advanced stage in prostate cancer," Am J Pathol. (2001) 159:2089-2094.
Sato et al., "Clinical significance of alterations of chromosome 8 in high-grade, advanced, nonmetastatic prostate carcinoma," J Natl Cancer Inst. (1999) 91:1574-1580.
Savinainen et al., "Expression and copy number analysis of TRPS 1, EIF3S3 and MYC genes in breast and prostate cancer," Br J Cancer (2004) 90: 1041-1046.
Savinainen et al., "Over expression of EIF3S3 promotes cancer cell growth," The Prostate (2006) 66:1144-1150.
Schlomm et al., "Molecular staging of prostate cancer in the year 2007," World .J. Urol. (Mar. 2007) 25(1):19-30.
Schmidt et al., "Lack of interferon consensus sequence binding protein (ICSBP) transcripts in human myeloid leukemias," Blood (1998) 91:22-29.
Schumacher et al., "A Common 8q24 Variant in Prostate and Breast Cancer from a Large Nested Case-Control Study," Cancer Res. (2007) 67:2951-2956.
Seiler et al., Oct. 2017, Impact of molecular subtypes in muscle-invasive bladder cancer on predicting response and survival after neoadjuvant chemotherapy, European Urology, 72(4):544-554.
Setlur et al., 2008, Estrogen-dependent signaling in a molecularly distinct subclass of aggressive prostate cancer, Journal of the National Cancer Institute, 100:815-813.
Severi et al., "The Common Variant rs1447295 on Chromosome 8q24 and Prostate Cancer Risk: Results from an Australian Population-based Case-Control Study", Cancer Epidemiology, Biomarkers & Prevention (2007) 16:610-611.
Shariat et al., "An updated catalog of prostate cancer predictive tools," Cancer (2008) 113(11):3062-6.
Shariat et al., "Surviving expression is associated with features of biologically aggressive prostate carcinoma," Cancer (2004) 100(4): 751-757.
Shen et al., "The SWI/SNF ATPase Brm is a gatekeeper of proliferative control in prostate cancer," Cancer Res. (Dec. 15, 2008) 68(24):10154-62.
Shibru et al., "Does the 3-gene diagnostic assay accurately distinguish benign from malignant thyroid neoplasms?" Cancer (Sep. 1, 2008) 113(5):930-5. doi: 10.1002/cncr.23703.
Shipley et al., "Radiation therapy for clinically localized prostate cancer: a multi-institutional pooled analysis," JAMA (1999) 281:1598-1604.
Simmons et al., "Natural history of biochemical recurrence after radical prostatectomy: risk assessment for secondary therapy," Eur Urol. (May 2007) 51(5):1175-84.
Singh et al., "Gene expression correlates of clinical prostate cancer behavior," Cancer Cell (Mar. 2002) vol. 1, pp. 1203-1209.
Singh et al., "LNA (locked nucleic acids): synthesis and high-affinity nucleic acid recognition," Chem Commun (1998) 4:455-456.
Singh et al., "Synthesis of 2'-amino-LNA: A novel conformationally restricted high-affinity oligonucleotide analogues with a handle," J Org Chem (1998) 63:10035-10039.
Slotkin et al., "Transposable elements and the epigenetic regulation of the genome." Nat Rev Genet. (Apr. 2007) 8(4):272-85.
Smit et al., "High-Resolution ERG-Expression Profiling on GeneChip Exon 1.0 ST Arrays in Primary and Castration-Resistant Prostate Cancer," BJU International (2013), 111(5):836-842, BJU International.
Solo et al., "Prevalence of prostate cancer (PC) clinical states (CS) in the United States: Estimates using a dynamic progression model," ASCO Annual Meeting, Journal of Clinical Oncology (May 20, 2011) vol. 29, No. 15, Abstract 4637.
Srikantan et al., "PCGEM1, a prostate-specific gene, is overexpressed in prostate cancer," PNAS (Oct. 24, 2000) 97(22): 12216-12221.
Stamey et al., "Molecular genetic profiling of Gleason grade 415 prostate cancers compared to benign prostatic hyperplasia," J Urol. (2001) 166(6):2171-2177.
Stanbrough et al., "Increased Expression of Genes Converting Adrenal Androgens to Testosterone in Androgen-Independent Prostate Cancer," Cancer Res (Mar. 1, 2006) 66(5):2815-2825.
Stavenhagen et al., "An ancient provirus has imposed androgen regulation on the adjacent mouse sex-limited protein Jene." Cell (Oct. 21, 1988) 55(2):247-54.
Stephenson et al., "Integration of gene expression profiling and clinical variables to predict prostate carcinoma recurrence after radical prostatectomy," Cancer (Jul. 15, 2005) 104(2):290-298.
Stephenson et al., "Postoperative Nomogram Predicting the 10-Year Probability of Prostate Cancer Recurrence After Radical Prostatectomy," J Clin Oncol (2008) vol. 23 (28), pp. 7005-7012.
Subramanian et al., "Gene set enrichment analysis: A knowledge-based approach for interpreting genome-wide expression profiles," PNAS USA (2005) 102:15545-15550.
Sun et al., "Aberrant expression of SWI/SNF catalytic subunits BRG1/BRM is associated with tumor development and increased invasiveness in prostate cancers," Prostate (Feb. 1, 2007) 67(2):203-13.
Taft et al., "Non-coding RNAs: regulators of disease," J Pathol. (Jan. 2010) 226(2):126-39.
Takayama et al., "TACC2 Is an Androgen-Responsive Cell Cycle Regulator Promoting Androgen-Mediated and Castration-Resistant Growth of Prostate Cancer," Mol Endocrinol (May 2012) 26(5):748-761.
Talantov et al., "Gene Based Prediction of Clinically Localized Prostate Cancer Progression After Radical Prostatectomy," The Journal Of Urology (Oct. 2016) vol. 184, 1521-1528.
Taylor et al., "Integrative genomic profiling of human prostate cancer," Cancer Cell (Jul. 13, 2010) vol. 18 (1), pp. 11-22.
Thompson et al., "Adjuvant and Salvage Radiotherapy After Prostatectomy: AUA/ASTRO Guideline," J Urol. (2013) 190(2):441-449.
Thompson et al., "Is the GPSM scoring algorithm for patients with prostate cancer valid in the contemporary era?" J Urol. (Aug. 2007) vol. 178 (2), 459-463.
Thorsen et al., "Alternative Splicing in Colon, Bladder, and Prostate Cancer Identified by Exon Array Analysis," Molecular & Cellular Proteomics (Mar. 18, 2008) vol. 7, No. 7, pp. 1214-1224.
Tockman et al., "Considerations in bringing a cancer biomarker to clinical application," Cancer Research (1992) 52:2711-2718.
Tollefson et al., "Stratification of Patient Risk Based on Prostate-Specific Antigen Doubling Time After Radical Retropubic Prostatectomy," Mayo Clin Proc. (2007) 82:422-427.
Tomlins et al., "Distinct classes of chromosomal rearrangements create oncogenic ETS gene fusions in prostate cancer," Nature (Aug. 2, 2007) 448(7153):595-9.
Tomlins et al., "Integrative molecular concept modeling of prostate cancer progression," Nat Genet. (2007) 39:41-51.
Tomlins et al., "Recurrent Fusion of TMPRSS2 and ETS Transcription Factor Genes in Prostate Cancer," Science (2005) 310(5748):644-648.
Tomlins et al., "TMPRSS2:ETV4 Gene Fusions Define a Third Molecular Subtype of Prostate Cancer," Cancer Res. (2006) 66:3396-3400.
Tricoli et al., "Detection of prostate cancer and predicting progression: current and future diagnostic markers," Clinical Cancer Research (Jun. 15, 2004) 10:3943-3953.

(56) References Cited

OTHER PUBLICATIONS

True et al., "A molecular correlate to the Gleason grading system for prostate adenocarcinoma," PNAS (Jul. 18, 2006) vol. 103, No. 29, pp. 10991-10996.
Tsuchiya et al., "Clinical significance in situ hybridization analysis in pathologic of alterations of chromosome 8 detected by fluorescence organ-confined prostate cancer," Genes Chromosomes Cancer (2002) 34:363-371.
Tsuchiya et al., "Mapping and gene expression profile of the minimally overrepresented 8q24 region in prostate cancer," Am J Pathol. (May 2002) 160(5):1799-1806.
Vainio, 2011, High-throughput screeing for novel prostate cancer drug targets, dissertation, Turun Yliopisot, University of Turku, Finland, 74 pp.
Vanaja et al., "PDLIM4 Repression by Hypermethylation as a Potential Biomarker for Prostate Cancer," Clin. Cancer Res. (2006) 12(4):1128-1136.
Vanaja et al., "Transcriptional Silencing of Zinc Finger Protein 185 Identified Profiling Is Associated with Prostate Cancer Progression," Cancer Research (Jul. 15, 2003) 63:3877-3882.
Varamblly et al., "Integrative Genomic and Proteomic Analysis of Prostate Cancer Reveals Signatures of Metastatic Progression," Cancer Cell (Nov. 2005) 8(5):393-406.
Varela et al., "Exome sequencing identifies frequent mutation of the SWI/SNF complex gene PBRM1 in renal carcinoma," Nature (Jan. 27, 2011) 469(7331):539-42.
Varricchi et al., "Are Mast Cells MASTers in Cancer?" Front Immunol. ePub (Apr. 12, 2017) 8:424.
Versteege et al., "Truncating mutations of hSNF5/INI1 in aggressive paediatric cancer." Nature (Jul. 9, 1998) 394 6689):203-6.
Vickers et al., "Extensions to decision curve analysis, a novel method for evaluating diagnostic tests, prediction models and molecular markers, BMC Medical Informatics and Decision Making," (2008) 8(53):1-17.
Visakorpi, "The molecular genetics of prostate cancer," Urology (2003) 62(5 Suppl 1):3-10.
Wang et al., "RNA-Seq: a revolutionary tool for transcriptomics," Nature Reviews/Genetics (Jan. 2009) vol. 10, pp. 57-63.
Wang et al., "Two common chromosome 8q24 variants are associated with increased risk for prostate cancer," Cancer Res. (2007) 67:2944-2950.
Warrick et al., 2016, FOXA1, GATA3 and PPARγ cooperate to drive luminal subtype in bladder cancer: a molecular analysis of established human cell lines, Scientific Reports, 6:38531, DOI: 10.1038, 15 pp.
Watson et al., "Future opportunities for the diagnosis and treatment of prostate cancer," Prostate Cancer Prostatic Dis. (2004) 7:S8-S13.
Weber et al., "The prognostic value of expression of HIF1[alpha], EGFR and VEGF-A, in localized prostate cancer for intermediate- and high-risk patients treated with radiation therapy with or without androgen deprivation therapy," Radiation Oncology (Apr. 30, 2012) vol. 7, No. 66, 8 pages.
Welsh et al., "Analysis of Gene Expression Identifies Candidate Markers and Pharmacological Targets in Prostate Cancer," Cancer Res. (Aug. 15, 2001) 61:5974-5978.
Wiegand et al., "ARID1A mutations in endometriosis-associated ovarian carcinomas," N Engl J Med. (Oct. 14, 2010) 363 (16):1532-43.
Willman et al., "Immunohistochemical staining for DNA topoisomerase II-alpha in benign, premalignant, and malignant lesions of the prostate," Prostate (Mar. 1, 2000) 42(4):280-286.
Winkler et al.: "Stage D1 prostatic adenocarcinoma: significance of nuclear DNA ploidy patterns studied by flow cytometry," Mayo Clin Proc. (1988) 63(2): 103-112.
Wyatt et al., "Heterogeneity in the inter-tumor transcriptome of high risk prostate cancer," *Genome Biology* (Aug. 26, 2014) vol. 15, No. 8, pp. 2-14.
Xiong et al., Dec. 2017, Low CCL17 expression associated with unfavorable postoperative prognosis of patients with clear cell renal cll carcinoma, BMC Cancer, 17(1):117.

Yap et al., "Molecular interplay of the noncoding RNA ANRIL and methylated histone H3 lysine 27 by polycomb CBX7 n transcriptional silencing of INK4a," Mol Cell. (Jun. 11, 2010) 38(5):662-74.
Yates et al., "X:Map: annotation and visualization of genome structure for Affymetrix exon array analysis," Nucleic Acids Res. (2008) vol. 36:D780-D786.
Yeager et al., "Genome-wide association study of prostate cancer identifies a second risk locus at 8q24," Nat Genet (2007) 39:645-649.
Yegnasubramanian et al., "DNA hypomethylation arises later in prostate cancer progression than CpG island hypermethylation and contributes to metastatic tumor heterogeneity," Cancer Res. (Nov. 1, 2008) 68(21): pp. 8954-8967.
Yeliin et al., "Widespread occurrence of antisense transcription in the human genome," Nat Biotechnol. (2003) 21(4):379-86.
You et al., Jun. 14, 2016, Integrated classification of prostate cancer reveals a novel luminal subtype with poor outcome, Cancer Research 76(17):4948-4958.
Yu et al., "An integrated network of androgen receptor, polycomb, and TMPRSS2-ERG gene fusions in prostate cancer progression," Cancer Cell. (May 18, 2010) 17(5):443-54.
Yu et al., "Gene expression alterations in prostate cancer predicting tumor aggression and preceding development of malignancy," J Clin Oncol. (Jul. 15, 2004) 22(14):2790-2799.
Yukinawa et al., "A multi-class predictor based on a probabilistic model: application to gene expression profiling-based diagnosis of thyroid tumors," BMC Genomics (Jul. 27, 2006) 7:190.
Zanetta et al., "Flow-cytometric analysis of deoxyribonucleic acid content in advanced ovarian carcinoma: its importance in long-term survival," Am J Obstet Gynecol (1996) 175(5): 1217-1225.
Zelefsky et al., "High dose radiation delivered by intensity modulated conformal radiotherapy improves the outcome of localized prostate cancer," The Journal of Urology (Sep. 2001) 166(3):876-881.
Zelefsky et al., "Neoadjuvant hormonal therapy improves the therapeutic ratio in patients with bulky prostatic cancer treated with three-dimensional conformal radiation therapy," Int J Radiat Oncol Biol Phys. (1994) 29:755-761.
Zhao et al., "Development and validation of a 24-gene predictor of response to postoperative radiotherapy in prostate cancer: a matched, retrospective analysis," Lancet Oncol (2016) 17, pp. 1612-1620.
GenBank Accession No. AA462934 dated Jun. 10, 1997, 2 pages.
GenBank Accession No. AA920095 dated Apr. 20, 1998, 2 pages.
GenBank Accession No. AB028840 dated Jan. 12, 2000, 2 pages.
GenBank Accession No. AB030836 dated Oct. 23, 1999, 2 pages.
GenBank Accession No. AB036741 dated Dec. 22, 2000, 3 pages.
GenBank Accession No. AF077349 dated Dec. 14, 2000, 2 pages.
GenBank Accession No. AF077351 dated Dec. 20, 2000, 3 pages.
GenBank Accession No. AF115517 dated Nov. 23, 2005, 4 pages.
GenBank Accession No. AI413910 dated Feb. 9, 1999, 2 pages.
GenBank Accession No. AI414999 dated Feb. 9, 1999, 2 pages.
GenBank Accession No. AI425960 dated Mar. 9, 1999, 2 pages.
GenBank Accession No. AI851940 dated Jul. 15, 1999, 2 pages.
GenBank Accession No. AK018022 dated Sep. 19, 2008, 4 pages.
GenBank Accession No. AK019341 dated Sep. 19, 2008, 3 pages.
GenBank Accession No. AK019342 dated Sep. 19, 2008, 3 pages.
GenBank Accession No. AK034387 dated Sep. 19, 2008, 4 pages.
GenBank Accession No. AK038229 dated Sep. 19, 2008, 4 pages.
GenBank Accession No. AK038434 dated Sep. 19, 2008, 4 pages.
GenBank Accession No. AK041534 dated Sep. 19, 2008, 4 pages.
GenBank Accession No. AK042683 dated Sep. 19, 2008, 4 pages.
GenBank Accession No. AK136096 dated Sep. 19, 2008, 4 pages.
GenBank Accession No. AK136101 dated Sep. 19, 2008, 4 pages.
GenBank Accession No. AK142768 dated Sep. 19, 2008, 3 pages.
GenBank Accession No. AL591433 dated Jan. 15, 2009, 56 pages.
GenBank Accession No. BC004702 dated Jul. 15, 2006, 3 pages.
GenBank Accession No. BC055737 dated Jul. 15, 2006, 2 pages.
GenBank Accession No. BC086799 dated Sep. 21, 2006, 3 pages.
GenBank Accession No. BF449664 dated Dec. 1, 2000, 1 page.
GenBank Accession No. BG063957 dated Jan. 26, 2001, 2 pages.
GenBank Accession No. BG077309 dated Dec. 17, 2003, 2 pages.
GenBank Accession No. BM114282 dated Jan. 30, 2002, 2 pages.
GenBank Accession No. BY023910 dated Dec. 6, 2002, 2 pages.

(56) References Cited

OTHER PUBLICATIONS

GenBank Accession No. CN724527 dated May 18, 2004, 2 pages.
GenBank Accession No. NM_000130 dated Oct. 18, 2009, 6 pages.
GenBank Accession No. NM_000493 dated Mar. 15, 2009, 4 pages.
GenBank Accession No. NM_000598, GI No. 62243067, dated Jun. 6, 2010, 5 pages.
GenBank Accession No. NM_000688, GI No. 40316942, dated Apr. 11, 2010, 5 pages.
GenBank Accession No. NM_001013398; GI No. 62243247, dated Jun. 6, 2010, 5 pages.
GenBank Accession No. NM_001034 dated Oct. 5, 2009, 5 pages.
GenBank Accession No. NM_001039573, GI No. 221316683, dated Mar. 4, 2010, 5 pages.
GenBank Accession No. NM_001049 dated Jun. 21, 2009, 4 pages.
GenBank Accession No. NM_001067 dated Oct. 18, 2009, 5 pages.
GenBank Accession No. NM_001098533, GI No. 237858579, dated May 7, 2010, 5 pages.
GenBank Accession No. NM_001130851; GI No. 195927024, dated Mar. 5, 2010, 4 pages.
GenBank Accession No. NM_001136154 dated Jan. 8, 2012, 6 pages.
GenBank Accession No. NM_001136155 dated Jan. 8, 2012, 6 pages.
GenBank Accession No. NM_001143998, GI No. 221316675, dated Mar. 4, 2010, 5 pages.
GenBank Accession No. NM_001143999, GI No. 221316679, dated Mar. 5, 2010, 5 pages.
GenBank Accession No. NM_001144001, GI No. 221316686, dated Mar. 4, 2010, 5 pages.
GenBank Accession No. NM_001160367, GI No. 237858581, dated May 7, 2010, 5 pages.
GenBank Accession No. NM_001786 dated Nov. 1, 2009, 4 pages.
GenBank Accession No. NM_001844 dated Sep. 28, 2009, 7 pages.
GenBank Accession No. NM_003003, GI No. 221316681, dated Mar. 4, 2010, 5 pages.
GenBank Accession No. NM_003014; GI No. 170784837, dated Mar. 13, 2010, 5 pages.
GenBank Accession No. NM_003184; GI No. 115527086, dated Mar. 4, 2010, 7 pages.
GenBank Accession No. NM_003873.3 dated Oct. 18, 2009, 4 pages.
GenBank Accession No. NM_004336; GI No. 211938448, dated Mar. 14, 2010, 6 pages.
GenBank Accession No. NM_004449 dated Jan. 8, 2012, 6 pages.
GenBank Accession No. NM_005025.2 dated Jul. 12, 2009, 4 pages.
GenBank Accession No. NM_005192, GI No. 195927023, dated Mar. 4, 2010, 4 pages.
GenBank Accession No. NM_005651.1 dated Oct. 27, 2009, 3 pages.
GenBank Accession No. NM_006265, GI No. 208879448, dated Apr. 11, 2010, 6 pages.
GenBank Accession No. NM_006558 dated 812109, 3 pages.
GenBank Accession No. NM_006727 dated Oct. 18, 2009, 3 pages.
GenBank Accession No. NM_006819; GI No. 110225356, dated May 17, 2010, 5 pages.
GenBank Accession No. NM_012152; GI No. 183396778, dated Apr. 5, 2010, 5 pages.
GenBank Accession No. NM_014846; GI No. 120952850, dated Mar. 4, 2010, 6 pages.
GenBank Accession No. NM_016623; GI No. 42734437, dated Mar. 29, 2009, 4 pages.
GenBank Accession No. NM_018930 dated Feb. 10, 2008, _ pages.
GenBank Accession No. NM_031966 GI No. 34304372, dated Jun. 6, 2010, 5 pages.
GenBank Accession No. NM_032334; GI No. 223468686, dated Mar. 5, 2010, 3 pages.
GenBank Accession No. NM_052987, GI No. 237858574, dated May 17, 2010, 5 pages.
GenBank Accession No. NM_052988, GI No. 237858573, dated May 17, 2010, 5 pages.
GenBank Accession No. NM_080546; GI No. 112363101, dated May 17, 2010, 6 pages.
GenBank Accession No. NM_080607 dated Sep. 3, 2009, 2 pages.
GenBank Accession No. NM_133445 dated Sep. 20, 2009, 5 pages.
GenBank Accession No. NM_138455; GI No. 34147546, dated May 7, 2010, 3 pages.
GenBank Accession No. NM_182918 dated Jan. 8, 2012, 6 pages.
GenBank Accession No. NM_199166, GI No. 40316938, dated Apr. 11, 2010, 5 pages.
GenBank Accession No. NP_001058 dated Dec. 25, 2011, 9 pages.
GenBank Accession No. W34764 dated May 13, 1996, 2 pages.
Supplemental Table 1 of U.S. Appl. No. 61/057,698, filed May 30, 2008, 13 pages.
Supplemental Table 2 of U.S. Appl. No. 61/057,698, filed May 30, 2008, 15 pages.
Supplemental Table 3 of U.S. Appl. No. 61/057,698, filed May 30, 2008, 21 pages.
Supplemental Table 4 of U.S. Appl. No. 61/057,698, filed May 30, 12008, 1 page.
Supplemental Table 5 of U.S. Appl. No. 61/057,698, filed May 30, 12008, 2 pages.
Supplemental Table 6 of U.S. Appl. No. 61/057,698, filed May 30, 2008, 1 page.
International Search Report and Written Opinion dated Mar. 1, 2018 in PCT/US2017/048486.

* cited by examiner

USE OF GENOMIC SIGNATURES TO PREDICT RESPONSIVENESS OF PATIENTS WITH PROSTATE CANCER TO POST-OPERATIVE RADIATION THERAPY

CROSS-REFERENCE TO RELATED APPLICATIONS

This application claims benefit of priority under 35 U.S.C. § 119(e) of U.S. Ser. No. 62/379,178, filed Aug. 24, 2016, the entire contents of which is incorporated herein by reference in its entirety.

FIELD OF THE INVENTION

The present invention pertains to the field of personalized medicine and methods for treating prostate cancer. In particular, the invention relates to the use of genomic signatures to identify individuals in need of treatment for prostate cancer who will be responsive to post-operative radiation therapy.

BACKGROUND OF THE INVENTION

Cancer is the uncontrolled growth of abnormal cells anywhere in a body. The abnormal cells are termed cancer cells, malignant cells, or tumor cells. Many cancers and the abnormal cells that compose the cancer tissue are further identified by the name of the tissue that the abnormal cells originated from (for example, prostate cancer). Cancer cells can proliferate uncontrollably and form a mass of cancer cells. Cancer cells can break away from this original mass of cells, travel through the blood and lymph systems, and lodge in other organs where they can again repeat the uncontrolled growth cycle. This process of cancer cells leaving an area and growing in another body area is often termed metastatic spread or metastatic disease. For example, if prostate cancer cells spread to a bone (or anywhere else), it can mean that the individual has metastatic prostate cancer.

Standard clinical parameters such as tumor size, grade, lymph node involvement and tumor-node-metastasis (TNM) staging (American Joint Committee on Cancer) may correlate with outcome and serve to stratify patients with respect to (neo)adjuvant chemotherapy, immunotherapy, antibody therapy and/or radiotherapy regimens. Incorporation of molecular markers in clinical practice may define tumor subtypes that are more likely to respond to targeted therapy. However, stage-matched tumors grouped by histological or molecular subtypes may respond differently to the same treatment regimen. Additional key genetic and epigenetic alterations may exist with important etiological contributions. A more detailed understanding of the molecular mechanisms and regulatory pathways at work in cancer cells and the tumor microenvironment (TME) could dramatically improve the design of novel anti-tumor drugs and inform the selection of optimal therapeutic strategies. The development and implementation of diagnostic, prognostic and therapeutic biomarkers to characterize the biology of each tumor may assist clinicians in making important decisions with regard to individual patient care and treatment.

This background information is provided for the purpose of making known information believed by the applicant to be of possible relevance to the present invention. No admission is necessarily intended, nor should be construed, that any of the preceding information constitutes prior art against the present invention.

SUMMARY OF THE INVENTION

The present invention is based on the discovery of a genomic signature that is useful for identifying individuals who will be responsive to post-operative radiation therapy for treatment of prostate cancer. In particular, the invention relates to a genomic signature based on expression levels of DNA damage repair genes that can be used to identify individuals likely to benefit from post-operative radiation therapy after a prostatectomy. The methods of the present invention are useful for generating a Post-Operative Radiation Therapy Outcome Score (PORTOS) to predict response to radiation therapy in prostate cancer patients.

In one aspect, the invention includes a method of predicting response to post-operative radiation therapy for prostate cancer, the method comprising: a) providing a biological sample comprising prostate cancer cells from a subject; b) assaying a level of expression of a plurality of genes in the biological sample, wherein said plurality of genes comprises one or more genes selected from the group consisting of DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2; c) calculating a post-operative radiation therapy outcome score (PORTOS) based on the levels of expression of the plurality of genes in the biological sample to determine whether or not the subject is likely to benefit from the post-operative radiation therapy. A PORTOS greater than 0 (i.e., high PORTOS) indicates that a subject will benefit from post-operative radiation therapy, whereas a PORTOS of less than or equal to 0 (i.e., low PORTOS) indicates that a subject will not benefit from post-operative radiation therapy.

In one embodiment, the plurality of genes comprises at least 2, 3, 4, 5, 6, 7, 8, 9, 10, 11, 12, 13, 14, 15, 16, 17, 18, 19, 20, 21, 22, 23, or 24 genes selected from the group consisting of DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2. In another embodiment, the plurality of genes comprises DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2. In another embodiment, the plurality of genes is selected from DRAM1 and KRT14; DRAM1, KRT14 and PTPN22; DRAM1, KRT14, PTPN22 and ZMAT3; DRAM1, KRT14, PTPN22, ZMAT3 and ARHGAP15; DRAM1, KRT14, PTPN22, ZMAT3, ARHGAP15 and IL1B; DRAM1, KRT14, PTPN22, ZMAT3, ARHGAP15, IL1B and ANLN; DRAM1, KRT14, PTPN22, ZMAT3, ARHGAP15, IL1B, ANLN and RPS27A; DRAM1, KRT14, PTPN22, ZMAT3, ARHGAP15, IL1B, ANLN, RPS27A and MUM1; DRAM1, KRT14, PTPN22, ZMAT3, ARHGAP15, IL1B, ANLN, RPS27A, MUM1 and TOP2A; DRAM1, KRT14, PTPN22, ZMAT3, ARHGAP15, IL1B, ANLN, RPS27A, MUM1, TOP2A and GNG11; DRAM1, KRT14, PTPN22, ZMAT3, ARHGAP15, IL1B, ANLN, RPS27A, MUM1, TOP2A, GNG11 and CDKN3; DRAM1, KRT14, PTPN22, ZMAT3, ARHGAP15, IL1B, ANLN, RPS27A, MUM1, TOP2A, GNG11, CDKN3 and HCLS1; DRAM1, KRT14, PTPN22, ZMAT3, ARHGAP15, IL1B, ANLN, RPS27A, MUM1, TOP2A, GNG11, CDKN3, HCLS1 and DTL; DRAM1, KRT14, PTPN22, ZMAT3, ARHGAP15, IL1B, ANLN, RPS27A, MUM1, TOP2A, GNG11, CDKN3, HCLS1, DTL and IL7R; DRAM1, KRT14, PTPN22, ZMAT3, ARHGAP15, IL1B, ANLN, RPS27A, MUM1, TOP2A, GNG11, CDKN3, HCLS1, DTL, IL7R and UBA7; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7 and NEK1; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1 and CDKN2AIP; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP and APEX2; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2 and KIF23; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23 and SULF2; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2 and PLK2; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2 and EME1; and DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1 and BIN2.

In certain embodiments, the method is performed after the patient undergoes a radical prostatectomy. The method is preferably performed prior to treatment of the subject with radiation therapy to determine if the subject will benefit from radiation therapy or should be administered some other anti-cancer treatment (e.g., chemotherapy, immunotherapy, hormonal therapy, biologic therapy, or a combination thereof). The method may also be performed while the subject is undergoing radiation therapy to help evaluate whether continued treatment is likely to be efficacious.

The biological sample obtained from a patient is typically a biopsy or tumor sample, but can be any sample from bodily fluids or tissue of the patient that contains cancerous cells. In certain embodiments, nucleic acids comprising sequences from genes selected from the group consisting of DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2, or complements thereof, are further isolated from the biological sample, and/or purified, and/or amplified prior to analysis.

The prostate cancer can be any type of prostate cancer, including but not limited to, adenocarcinoma, small cell prostate cancer, non-small cell prostate cancer, neuroendocrine prostate cancer, or metastatic castration resistant prostate cancer. Additionally, the prostate cancer may be biochemically recurrent or metastatic prostate cancer.

The expression levels of biomarker nucleic acids can be determined by a variety of methods including, but not limited to, microarray analysis, polymerase chain reaction (PCR), reverse transcriptase polymerase chain reaction (RT-PCR), a Northern blot, and serial analysis of gene expression (SAGE).

In one aspect, the method further comprises prescribing and/or administering the post-operative radiation therapy to the subject if the PORTOS indicates that the subject will benefit from the radiation therapy, or prescribing and/or administering a cancer treatment other than the post-operative radiation therapy to the subject if the PORTOS indicates the subject will not benefit from the post-operative radiation therapy.

In one aspect, the invention includes a method of predicting response to post-operative radiation therapy for prostate cancer, the method comprising: a) providing a biological sample comprising prostate cancer cells from a subject; b) assaying a level of expression of a plurality of genes in the biological sample, wherein said plurality of genes comprises one or more genes selected from the group consisting of DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2; c) calculating a post-operative radiation therapy outcome score (PORTOS) based on the levels of expression of the plurality of genes in the biological sample to determine whether or not the subject is likely to benefit from the post-operative radiation therapy. A PORTOS greater than 0 (i.e., high PORTOS) indicates that a subject will benefit from post-operative radiation therapy, whereas a PORTOS of less than or equal to 0 (i.e., low PORTOS) indicates that a subject will not benefit from post-operative radiation therapy.

In one aspect, the method further comprises prescribing and/or administering the post-operative radiation therapy to the subject if the PORTOS indicates that the subject will benefit from the radiation therapy, or prescribing and/or administering a cancer treatment other than the post-operative radiation therapy to the subject if the PORTOS indicates the subject will not benefit from the post-operative radiation therapy.

In one aspect, the method further comprises prescribing and/or administering the post-operative radiation therapy to the subject if the PORTOS indicates that the subject will benefit from the radiation therapy, or prescribing and/or administering a cancer treatment other than the post-operative radiation therapy to the subject if the PORTOS indicates the subject will not benefit from the post-operative radiation therapy.

In one embodiment, the plurality of genes comprises at least 2, 3, 4, 5, 6, 7, 8, 9, 10, 11, 12, 13, 14, 15, 16, 17, 18, 19, 20, 21, 22, 23, or 24 genes selected from the group consisting of DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2. In another embodiment, the plurality of genes comprises DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2. In another embodiment, the plurality of genes is selected from DRAM1 and KRT14; DRAM1, KRT14 and PTPN22; DRAM1, KRT14, PTPN22 and ZMAT3; DRAM1, KRT14, PTPN22, ZMAT3 and ARHGAP15; DRAM1, KRT14, PTPN22, ZMAT3, ARHGAP15 and IL1B; DRAM1, KRT14, PTPN22, ZMAT3, ARHGAP15, IL1B and ANLN; DRAM1, KRT14, PTPN22, ZMAT3, ARHGAP15, IL1B, ANLN and RPS27A; DRAM1, KRT14, PTPN22, ZMAT3, ARHGAP15, IL1B, ANLN, RPS27A and MUM1; DRAM1, KRT14, PTPN22, ZMAT3, ARHGAP15, IL1B, ANLN, RPS27A, MUM1 and TOP2A; DRAM1, KRT14, PTPN22, ZMAT3, ARHGAP15, IL1B, ANLN, RPS27A, MUM1, TOP2A and GNG11; DRAM1, KRT14, PTPN22, ZMAT3, ARHGAP15, IL1B, ANLN, RPS27A, MUM1, TOP2A, GNG11 and CDKN3; DRAM1, KRT14, PTPN22, ZMAT3, ARHGAP15, IL1B, ANLN, RPS27A, MUM1, TOP2A, GNG11, CDKN3 and HCLS1; DRAM1, KRT14, PTPN22, ZMAT3, ARHGAP15, IL1B, ANLN, RPS27A, MUM1, TOP2A, GNG11, CDKN3, HCLS1 and DTL; DRAM1, KRT14, PTPN22, ZMAT3, ARHGAP15, IL1B, ANLN, RPS27A, MUM1, TOP2A, GNG11, CDKN3, HCLS1, DTL and IL7R; DRAM1, KRT14, PTPN22, ZMAT3, ARHGAP15, IL1B, ANLN, RPS27A, MUM1, TOP2A, GNG11, CDKN3, HCLS1, DTL, IL7R and UBA7; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7 and NEK1; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1 and CDKN2AIP; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP and APEX2; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2 and KIF23; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23 and SULF2; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2 and PLK2; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2 and EME1; and DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1 and BIN2.

In certain embodiments, the method is performed after the patient undergoes a radical prostatectomy. The method is preferably performed prior to treatment of the subject with radiation therapy to determine if the subject will benefit from radiation therapy or should be administered some other anti-cancer treatment (e.g., chemotherapy, immunotherapy, hormonal therapy, biologic therapy, or a combination thereof). The method may also be performed while the subject is undergoing radiation therapy to help evaluate whether continued treatment is likely to be efficacious.

The biological sample obtained from a patient is typically a biopsy or tumor sample, but can be any sample from bodily fluids or tissue of the patient that contains cancerous cells. In certain embodiments, nucleic acids comprising sequences from genes selected from the group consisting of DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2, or complements thereof, are further isolated from the biological sample, and/or purified, and/or amplified prior to analysis.

The prostate cancer can be any type of prostate cancer, including but not limited to, adenocarcinoma, small cell prostate cancer, non-small cell prostate cancer, neuroendocrine prostate cancer, or metastatic castration resistant prostate cancer. Additionally, the prostate cancer may be biochemically recurrent or metastatic prostate cancer.

The expression levels of biomarker nucleic acids can be determined by a variety of methods including, but not limited to, microarray analysis, polymerase chain reaction (PCR), reverse transcriptase polymerase chain reaction (RT-PCR), a Northern blot, and serial analysis of gene expression (SAGE).

In another aspect, the invention includes a method of treating a subject for prostate cancer, the method comprising: a) determining whether or not the subject is likely to benefit from post-operative radiation therapy according to a PORTOS as described herein; and b) administering post-operative radiation therapy to the subject if the PORTOS indicates that the subject will benefit from post-operative radiation therapy, or administering a cancer treatment other than post-operative radiation therapy to the subject if the PORTOS indicates that the subject will not benefit from post-operative radiation therapy. Subjects, especially those identified as not likely to benefit from radiation therapy may be administered other cancer treatments such as, but not limited to, chemotherapy, immunotherapy, hormonal therapy, biologic therapy, or any combination thereof.

In another aspect, the invention includes a method for determining a treatment for a subject who has prostate cancer, the method comprising: a) determining whether or not the subject is likely to benefit from post-operative radiation therapy according to a PORTOS as described herein; and b) prescribing radiation therapy to the subject if the PORTOS indicates that the subject will benefit from radiation therapy, or prescribing a cancer treatment other than radiation therapy to the subject if the PORTOS indicates the subject will not benefit from radiation therapy.

In another aspect, the invention includes a probe set for predicting response of a subject to post-operative radiation therapy for prostate cancer, the probe set comprising a plurality of probes for detecting a plurality of target nucleic acids, wherein the plurality of target nucleic acids comprises one or more gene sequences, or complements thereof, of genes selected from the group consisting of DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2. Probes may be detectably labeled to facilitate detection. In one embodiment, the probe set comprises a plurality of probes for detecting a plurality of target nucleic acids comprising gene sequences, or complements thereof, of the genes DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2.

In another aspect, the invention includes a system for predicting response of a subject to post-operative radiation therapy for prostate cancer, the system comprising: a) a probe set described herein; and b) an algorithm for generating a post-operative radiation therapy outcome score (PORTOS) based on an expression level of the plurality of target nucleic acids hybridized to the probes of the probe set in a biological sample from the subject.

In another aspect, the invention includes a kit for predicting response of a subject to post-operative radiation therapy for prostate cancer, the kit comprising agents for measuring levels of expression of a plurality of genes, wherein the plurality of genes comprises one or more genes selected from the group consisting of DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2. The kit may include one or more agents (e.g., hybridization probes, PCR primers, or microarray) for measuring levels of expression of a plurality of genes, wherein said plurality of genes comprises one or more genes selected from the group consisting of DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2, a container for holding a biological sample comprising prostate cancer cells isolated from a human subject for testing, and printed instructions for reacting the agents with the biological sample or a portion of the biological sample to determine whether or not the subject is likely to benefit from radiation therapy. The agents may be packaged in separate containers. The kit may further comprise one or more control reference samples or other reagents for measuring gene expression (e.g., reagents for performing PCR, RT-PCR, microarray analysis, a Northern blot, SAGE, or an immunoassay). In one embodiment, the kit comprises agents for measuring the levels of expression of the genes DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2. For example, the kit may comprise a probe set, as described herein, for detecting a plurality of target nucleic acids, wherein the plurality of target nucleic acids comprises one or more gene sequences, or complements thereof, of genes selected from DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2, or any combination thereof.

In another embodiment, the kit further comprises a system for predicting response of a subject to post-operative radiation therapy for prostate cancer, wherein the system comprises: a) a probe set comprising a plurality of probes for detecting a plurality of target nucleic acids, wherein the plurality of target nucleic acids comprises one or more gene sequences, or complements thereof, of genes selected from DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2, or any combination thereof; and b) an algorithm for generating a post-operative radiation therapy outcome score (PORTOS) based on an expression level of the plurality of target nucleic acids hybridized to the plurality of probes in a biological sample from the subject.

In another aspect, the invention includes a computer implemented method for predicting response of a patient to post-operative radiation therapy for prostate cancer, the computer performing steps comprising: a) receiving inputted patient data comprising values for levels of expression of a plurality of genes, wherein said plurality of genes comprises one or more genes selected from the group consisting of DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2 in a biological sample comprising prostate cancer cells from the patient; b) calculating a post-operative radiation therapy outcome score (PORTOS) based on the levels of expression of the plurality of genes to determine whether or not the patient is likely to benefit from the radiation therapy, wherein a PORTOS greater than 0 indicates that the patient will benefit from the radiation therapy and a PORTOS less than or equal to 0 indicates that the patient will not benefit from the radiation therapy; and c) displaying information regarding whether or not the patient is likely to benefit from the post-operative radiation therapy. In one embodiment, the plurality of genes comprises at least 2, 3, 4, 5, 6, 7, 8, 9, 10, 11, 12, 13, 14, 15, 16, 17, 18, 19, 20, 21, 22, 23, or 24 genes selected from the group consisting of DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2. In another embodiment, the plurality of genes comprises DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2. In another embodiment, the plurality of genes is selected from DRAM1 and KRT14; DRAM1, KRT14 and PTPN22; DRAM1, KRT14, PTPN22 and ZMAT3; DRAM1, KRT14, PTPN22, ZMAT3 and ARHGAP15; DRAM1, KRT14, PTPN22, ZMAT3, ARHGAP15 and IL1B; DRAM1, KRT14, PTPN22, ZMAT3, ARHGAP15, IL1B and ANLN; DRAM1, KRT14, PTPN22, ZMAT3, ARHGAP15, IL1B, ANLN and RPS27A; DRAM1, KRT14, PTPN22, ZMAT3, ARHGAP15, IL1B, ANLN, RPS27A and MUM1; DRAM1, KRT14, PTPN22, ZMAT3, ARHGAP15, IL1B, ANLN, RPS27A, MUM1 and TOP2A; DRAM1, KRT14, PTPN22, ZMAT3, ARHGAP15, IL1B, ANLN, RPS27A, MUM1, TOP2A and GNG11; DRAM1, KRT14, PTPN22, ZMAT3, ARHGAP15, IL1B, ANLN, RPS27A, MUM1, TOP2A, GNG11 and CDKN3; DRAM1, KRT14, PTPN22, ZMAT3, ARHGAP15, IL1B, ANLN, RPS27A, MUM1, TOP2A, GNG11, CDKN3 and HCLS1; DRAM1, KRT14, PTPN22, ZMAT3, ARHGAP15, IL1B, ANLN, RPS27A, MUM1, TOP2A, GNG11, CDKN3, HCLS1 and DTL; DRAM1, KRT14, PTPN22, ZMAT3, ARHGAP15, IL1B, ANLN, RPS27A, MUM1, TOP2A, GNG11, CDKN3, HCLS1, DTL and IL7R; DRAM1, KRT14, PTPN22, ZMAT3, ARHGAP15, IL1B, ANLN, RPS27A, MUM1, TOP2A, GNG11, CDKN3, HCLS1, DTL, IL7R and UBA7; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7 and NEK1; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1 and CDKN2AIP; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP and APEX2; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2 and KIF23; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23 and SULF2; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2 and PLK2; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2 and EME1; and DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1 and BIN2.

The significance of the expression levels of one or more biomarker genes may be evaluated using, for example, a T-test, P-value, KS (Kolmogorov Smirnov) P-value, accuracy, accuracy P-value, positive predictive value (PPV), negative predictive value (NPV), sensitivity, specificity, AUC, AUC P-value (Auc.pvalue), Wilcoxon Test P-value, Median Fold Difference (MFD), Kaplan Meier (KM) curves, survival AUC (survAUC), Kaplan Meier P-value (KM P-value), Univariable Analysis Odds Ratio P-value (uvaORPval), multivariable analysis Odds Ratio P-value (mvaORPval), Univariable Analysis Hazard Ratio P-value (uvaHRPval) and Multivariable Analysis Hazard Ratio P-value (mvaHRPval). The significance of the expression level of the one or more targets may be based on two or more metrics selected from the group comprising AUC, AUC P-value (Auc.pvalue), Wilcoxon Test P-value, Median Fold Difference (MFD), Kaplan Meier (KM) curves, survival AUC (survAUC), Univariable Analysis Odds Ratio P-value (uvaORPval), multivariable analysis Odds Ratio P-value (mvaORPval), Kaplan Meier P-value (KM P-value), Univariable Analysis Hazard Ratio P-value (uvaHRPval) or Multivariable Analysis Hazard Ratio P-value (mvaHRPval).

These and other embodiments of the subject invention will readily occur to those of skill in the art in view of the disclosure herein.

INCORPORATION BY REFERENCE

All publications, patents, and patent applications mentioned in this specification are herein incorporated by reference in their entireties to the same extent as if each individual publication, patent, or patent application was specifically and individually indicated to be incorporated by reference.

DETAILED DESCRIPTION OF THE INVENTION

Figure 1A:
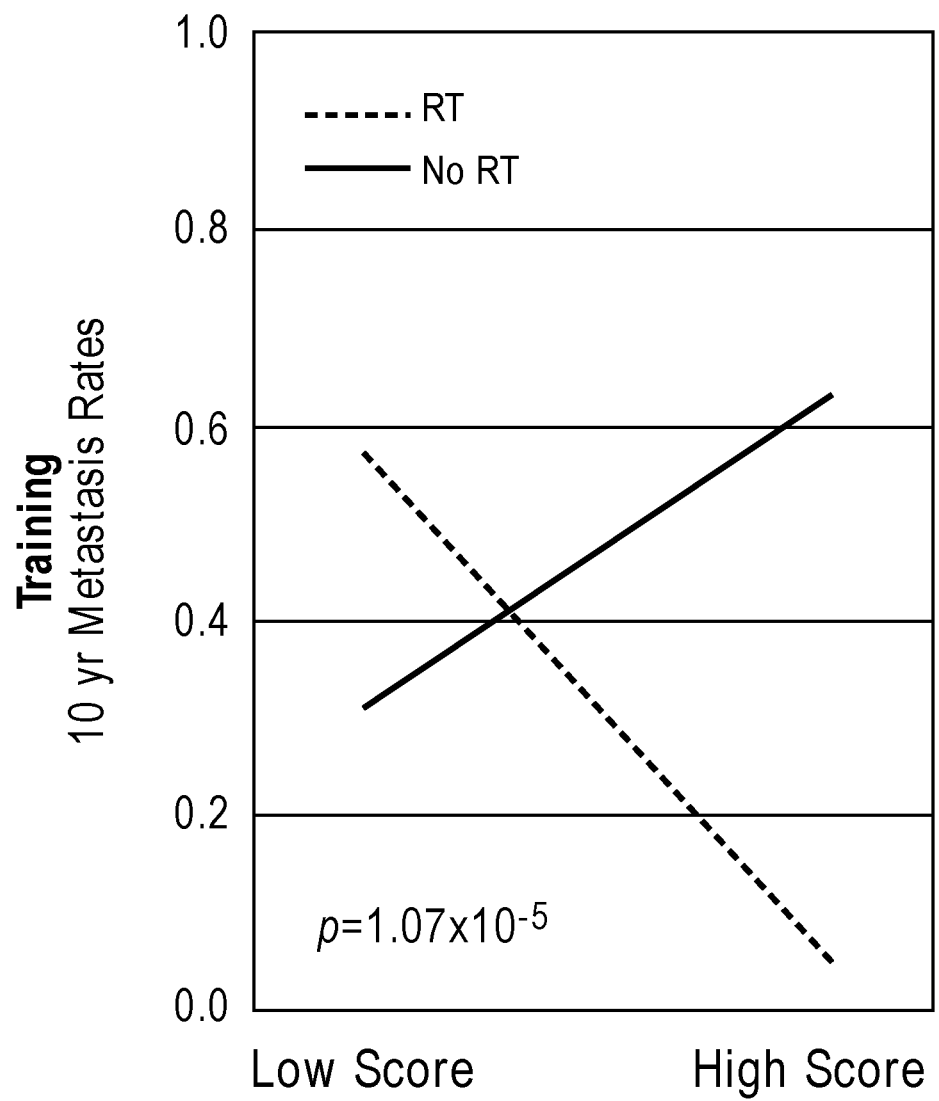
FIGS. 1A-1D show interaction and bar plots of 10-year metastasis rates in a training and validation cohorts when comparing low and high PORTOS. In the line plots: Gray=treated with RT, black=not treated with RT. In the bar plots: Gray=low PORTOS, Black=high PORTOS, error bars=standard error.

The practice of the present invention will employ, unless otherwise indicated, conventional methods of medicine, biochemistry, molecular biology and recombinant DNA techniques, within the skill of the art. Such techniques are explained fully in the literature. See, e.g., *Radiotherapy in Prostate Cancer: Innovative Techniques and Current Controversies* (Medical Radiology, H. Geinitz, M. Roach III, and N. van As eds., Springer, 2015); *Prostate Cancer: Science and Clinical Practice* (J. H. Mydlo and C. J. Godec eds., Academic Press, $2^{nd}$ edition, 2015); *Prostate Cancer: Biochemistry, Molecular Biology and Genetics* (Protein Reviews 16, D. J. Tindall ed., Springer, 2013); A. L. Lehninger, *Biochemistry* (Worth Publishers, Inc., current addition); Sambrook, et al., *Molecular Cloning: A Laboratory Manual* ($3^{rd}$ Edition, 2001); and *Methods In Enzymology* (S. Colowick and N. Kaplan eds., Academic Press, Inc.).

I. Definitions

In describing the present invention, the following terms will be employed, and are intended to be defined as indicated below.

It must be noted that, as used in this specification and the appended claims, the singular forms "a," "an" and "the" include plural referents unless the content clearly dictates otherwise. Thus, for example, reference to "a nucleic acid" includes a mixture of two or more such nucleic acids, and the like.

The term "survival" as used herein means the time from the start of cancer treatment (e.g., radiation therapy) to the time of death.

The terms "tumor," "cancer" and "neoplasia" are used interchangeably and refer to a cell or population of cells whose growth, proliferation or survival is greater than growth, proliferation or survival of a normal counterpart cell, e.g. a cell proliferative, hyperproliferative or differentiative disorder. Typically, the growth is uncontrolled. The term "malignancy" refers to invasion of nearby tissue. The term "metastasis" or a secondary, recurring or recurrent tumor, cancer or neoplasia refers to spread or dissemination of a tumor, cancer or neoplasia to other sites, locations or regions within the subject, in which the sites, locations or regions are distinct from the primary tumor or cancer. Neoplasia, tumors and cancers include benign, malignant, metastatic and non-metastatic types, and include any stage (I, II, III, IV or V) or grade (G1, G2, G3, etc.) of neoplasia, tumor, or cancer, or a neoplasia, tumor, cancer or metastasis that is progressing, worsening, stabilized or in remission. In particular, the terms "tumor," "cancer" and "neoplasia" include carcinomas, such as squamous cell carcinoma, adenocarcinoma, adenosquamous carcinoma, anaplastic carcinoma, large cell carcinoma, and small cell carcinoma.

The term "derived from" is used herein to identify the original source of a molecule but is not meant to limit the method by which the molecule is made which can be, for example, by chemical synthesis or recombinant means.

"Recombinant" as used herein to describe a nucleic acid molecule means a polynucleotide of genomic, cDNA, viral, semisynthetic, or synthetic origin which, by virtue of its origin or manipulation is not associated with all or a portion of the polynucleotide with which it is associated in nature. The term "recombinant" as used with respect to a protein or polypeptide means a polypeptide produced by expression of a recombinant polynucleotide. In general, the gene of interest is cloned and then expressed in transformed organisms, as described further below. The host organism expresses the foreign gene to produce the protein under expression conditions.

"Substantially purified" generally refers to isolation of a substance (compound, polynucleotide, oligonucleotide, protein, or polypeptide) such that the substance comprises the majority percent of the sample in which it resides. Typically in a sample, a substantially purified component comprises 50%, preferably 80%-85%, more preferably 90-95% of the sample. Techniques for purifying polynucleotides oligonucleotides and polypeptides of interest are well-known in the art and include, for example, ion-exchange chromatography, affinity chromatography and sedimentation according to density.

By "isolated" is meant, when referring to a polypeptide, that the indicated molecule is separate and discrete from the whole organism with which the molecule is found in nature or is present in the substantial absence of other biological macro molecules of the same type. The term "isolated" with respect to a polynucleotide or oligonucleotide is a nucleic acid molecule devoid, in whole or part, of sequences normally associated with it in nature; or a sequence, as it exists in nature, but having heterologous sequences in association therewith; or a molecule disassociated from the chromosome.

The terms "polynucleotide," "oligonucleotide," "nucleic acid" and "nucleic acid molecule" are used herein to include a polymeric form of nucleotides of any length, either ribonucleotides or deoxyribonucleotides. This term refers only to the primary structure of the molecule. Thus, the term includes triple-, double- and single-stranded DNA, as well as triple-, double- and single-stranded RNA. It also includes modifications, such as by methylation and/or by capping, and unmodified forms of the polynucleotide. More particularly, the terms "polynucleotide," "oligonucleotide," "nucleic acid" and "nucleic acid molecule" include polydeoxyribonucleotides (containing 2-deoxy-D-ribose), polyribonucleotides (containing D-ribose), any other type of polynucleotide which is an N- or C-glycoside of a purine or pyrimidine base, and other polymers containing nonnucleotidic backbones, for example, polyamide (e.g., peptide nucleic acids (PNAs)) and polymorpholino (commercially available from the Anti-Virals, Inc., Corvallis, Oreg., as Neugene) polymers, and other synthetic sequence-specific nucleic acid polymers providing that the polymers contain nucleobases in a configuration which allows for base pairing and base stacking, such as is found in DNA and RNA. There is no intended distinction in length between the terms "polynucleotide," "oligonucleotide," "nucleic acid" and "nucleic acid molecule," and these terms will be used interchangeably. Thus, these terms include, for example, 3'-deoxy-2',5'-DNA, oligodeoxyribonucleotide N3' P5' phosphoramidates, 2'-O-alkyl-substituted RNA, double- and single-stranded DNA, as well as double- and single-stranded RNA, DNA:RNA hybrids, and hybrids between PNAs and DNA or RNA, and also include known types of modifications, for example, labels which are known in the art, methylation, "caps," substitution of one or more of the naturally occurring nucleotides with an analog, internucleotide modifications such as, for example, those with uncharged linkages (e.g., methyl phosphonates, phosphotriesters, phosphoramidates, carbamates, etc.), with negatively charged linkages (e.g., phosphorothioates, phosphorodithioates, etc.), and with positively charged linkages (e.g., aminoalklyphosphoramidates, aminoalkylphosphotriesters), those containing pendant moieties, such as, for example, proteins (including nucleases, toxins, antibodies, signal peptides, poly-L-lysine, etc.), those with intercalators (e.g., acridine, psoralen, etc.), those containing chelators (e.g., metals, radioactive metals, boron, oxidative metals, etc.), those containing alkylators, those with modified linkages (e.g., alpha anomeric nucleic acids, etc.), as well as unmodified forms of the polynucleotide or oligonucleotide. The term also includes locked nucleic acids (e.g., comprising a ribonucleotide that has a methylene bridge between the 2'-oxygen atom and the 4'-carbon atom). See, for example, Kurreck et al. (2002) Nucleic Acids Res. 30: 1911-1918; Elayadi et al. (2001) Curr. Opinion Invest. Drugs 2: 558-561; Orum et al. (2001) Curr. Opinion Mol. Ther. 3: 239-243; Koshkin et al. (1998) Tetrahedron 54: 3607-3630; Obika et al. (1998) Tetrahedron Lett. 39: 5401-5404.

As used herein, the term "probe" or "oligonucleotide probe" refers to a polynucleotide, as defined above, that contains a nucleic acid sequence complementary to a nucleic acid sequence present in the target nucleic acid analyte (e.g., biomarker). The polynucleotide regions of probes may be composed of DNA, and/or RNA, and/or synthetic nucleotide analogs. Probes may be labeled in order to detect the target sequence. Such a label may be present at the 5' end, at the 3' end, at both the 5' and 3' ends, and/or internally.

The term "primer" or "oligonucleotide primer" as used herein, refers to an oligonucleotide that hybridizes to the template strand of a nucleic acid and initiates synthesis of a nucleic acid strand complementary to the template strand when placed under conditions in which synthesis of a primer extension product is induced, i.e., in the presence of nucleotides and a polymerization inducing agent such as a DNA or RNA polymerase and at suitable temperature, pH, metal concentration, and salt concentration. The primer is preferably single stranded for maximum efficiency in amplification, but may alternatively be double stranded. If double stranded, the primer can first be treated to separate its strands before being used to prepare extension products. This denaturation step is typically effected by heat, but may alternatively be carried out using alkali, followed by neutralization. Thus, a "primer" is complementary to a template, and complexes by hydrogen bonding or hybridization with the template to give a primer/template complex for initiation of synthesis by a polymerase, which is extended by the addition of covalently bonded bases linked at its 3' end complementary to the template in the process of DNA or RNA synthesis. Typically, nucleic acids are amplified using at least one set of oligonucleotide primers comprising at least one forward primer and at least one reverse primer capable of hybridizing to regions of a nucleic acid flanking the portion of the nucleic acid to be amplified.

The term "amplicon" refers to the amplified nucleic acid product of a PCR reaction or other nucleic acid amplification process (e.g., ligase chain reaction (LGR), nucleic acid sequence based amplification (NASBA), transcription-mediated amplification (TMA), Q-beta amplification, strand displacement amplification, or target mediated amplification). Amplicons may comprise RNA or DNA depending on the technique used for amplification.

The terms "hybridize" and "hybridization" refer to the formation of complexes between nucleotide sequences which are sufficiently complementary to form complexes via Watson-Crick base pairing.

It will be appreciated that the hybridizing sequences need not have perfect complementarity to provide stable hybrids. In many situations, stable hybrids will form where fewer than about 10% of the bases are mismatches, ignoring loops of four or more nucleotides. Accordingly, as used herein the term "complementary" refers to an oligonucleotide that forms a stable duplex with its "complement" under assay conditions, generally where there is about 90% or greater homology.

The terms "selectively detects" or "selectively detecting" refer to the detection of nucleic acids using oligonucleotides, e.g., primers or probes that are capable of detecting a particular nucleic acid, for example, by amplifying and/or binding to at least a portion of the biomarker nucleic acid, but do not amplify and/or bind to sequences from other nucleic acids under appropriate hybridization conditions.

As used herein, the terms "label" and "detectable label" refer to a molecule capable of detection, including, but not limited to, radioactive isotopes, fluorescers, chemiluminescers, chromophores, enzymes, enzyme substrates, enzyme cofactors, enzyme inhibitors, semiconductor nanoparticles, dyes, metal ions, metal sols, ligands (e.g., biotin, streptavidin or haptens) and the like. The term "fluorescer" refers to a substance or a portion thereof which is capable of exhibiting fluorescence in the detectable range. Particular examples of labels which may be used in the practice of the invention include, but are not limited to, a SYBR dye such as SYBR green and SYBR gold, a CAL Fluor dye such as CAL Fluor Gold 540, CAL Fluor Orange 560, CAL Fluor Red 590, CAL Fluor Red 610, and CAL Fluor Red 635, a Quasar dye such as Quasar 570, Quasar 670, and Quasar 705, an Alexa Fluor such as Alexa Fluor 350, Alexa Fluor 488, Alexa Fluor 546, Alexa Fluor 555, Alexa Fluor 594, Alexa Fluor 647, and Alexa Fluor 784, a cyanine dye such as Cy 3, Cy3.5, Cy5, Cy5.5, and Cy7, fluorescein, 2', 4', 5', 7'-tetrachloro-4-7-dichlorofluorescein (TET), carboxyfluorescein (FAM), 6-carboxy-4',5'-dichloro-2',7'-dimethoxyfluorescein (JOE), hexachlorofluorescein (HEX), rhodamine, carboxy-X-rhodamine (ROX), tetramethyl rhodamine (TAMRA), FITC, dansyl, umbelliferone, dimethyl acridinium ester (DMAE), Texas red, luminol, quantum dots, NADPH, horseradish peroxidase (HRP), α-galactosidase, and β-galactosidase.

The terms "subject," "individual," and "patient," are used interchangeably herein and refer to any mammalian subject, particularly humans. Other subjects may include cattle, dogs, cats, guinea pigs, rabbits, rats, mice, horses, and so on. In some cases, the methods of the invention find use in experimental animals, in veterinary application, and in the development of animal models, including, but not limited to, rodents including mice, rats, and hamsters; and primates.

II. Modes of Carrying Out the Invention

Before describing the present invention in detail, it is to be understood that this invention is not limited to particular formulations or process parameters as such may, of course, vary. It is also to be understood that the terminology used herein is for the purpose of describing particular embodiments of the invention only, and is not intended to be limiting.

Although a number of methods and materials similar or equivalent to those described herein can be used in the practice of the present invention, the preferred materials and methods are described herein.

The present invention is based on the discovery of a genomic signature that is useful for identifying individuals who will be responsive to post-operative radiation therapy for treatment of prostate cancer. In particular, the invention relates to a genomic signature based on expression levels of DNA damage repair genes that can be used to identify individuals likely to benefit from post-operative radiation therapy after a prostatectomy (see Examples).

In order to further an understanding of the invention, a more detailed discussion is provided below regarding the genomic signature and methods of screening and treating subjects for prostate cancer.

A Genomic Signature for Predicting Response to Radiation Therapy

A genomic signature based on gene expression of DNA damage repair genes can be utilized to identify prostate cancer patients that may potentially benefit from radiation therapy. Exemplary DNA damage repair genes that display expression patterns that predict response to radiation therapy include DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2.

In one aspect the invention includes a method of predicting the response of a subject to post-operative radiation therapy for prostate cancer. The method generally comprises: a) providing a biological sample comprising prostate cancer cells from a subject; b) assaying a level of expression of a plurality of genes in the biological sample, wherein the plurality of genes comprises one or more genes selected from the group consisting of DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2; and c) predicting whether or not the subject is likely to benefit from post-operative radiation therapy based on the level of expression of the plurality of genes.

In certain embodiments, the plurality of genes comprises at least 2, at least 3, at least 4, at least 5, at least 6, at least 7, at least 8, at least 9, or at least 10 genes or more genes selected from the group consisting of DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2. In one embodiment, the plurality of genes comprises DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2. In another embodiment, the plurality of genes is selected from DRAM1 and KRT14; DRAM1, KRT14 and PTPN22; DRAM1, KRT14, PTPN22 and ZMAT3; DRAM1, KRT14, PTPN22, ZMAT3 and ARHGAP15; DRAM1, KRT14, PTPN22, ZMAT3, ARHGAP15 and IL1B; DRAM1, KRT14, PTPN22, ZMAT3, ARHGAP15, IL1B and ANLN; DRAM1, KRT14, PTPN22, ZMAT3, ARHGAP15, IL1B, ANLN and RPS27A; DRAM1, KRT14, PTPN22, ZMAT3, ARHGAP15, IL1B, ANLN, RPS27A and MUM1; DRAM1, KRT14, PTPN22, ZMAT3, ARHGAP15, IL1B, ANLN, RPS27A, MUM1 and TOP2A; DRAM1, KRT14, PTPN22, ZMAT3, ARHGAP15, IL1B, ANLN, RPS27A, MUM1, TOP2A and GNG11; DRAM1, KRT14, PTPN22, ZMAT3, ARHGAP15, IL1B, ANLN, RPS27A, MUM1, TOP2A, GNG11 and CDKN3; DRAM1, KRT14, PTPN22, ZMAT3, ARHGAP15, IL1B, ANLN, RPS27A, MUM1, TOP2A, GNG11, CDKN3 and HCLS1; DRAM1, KRT14, PTPN22, ZMAT3, ARHGAP15, IL1B, ANLN, RPS27A, MUM1, TOP2A, GNG11, CDKN3, HCLS1 and DTL; DRAM1, KRT14, PTPN22, ZMAT3, ARHGAP15, IL1B, ANLN, RPS27A, MUM1, TOP2A, GNG11, CDKN3, HCLS1, DTL and IL7R; DRAM1, KRT14, PTPN22, ZMAT3, ARHGAP15, IL1B, ANLN, RPS27A, MUM1, TOP2A, GNG11, CDKN3, HCLS1, DTL, IL7R and UBA7; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7 and NEK1; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1 and CDKN2AIP; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP and APEX2; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2 and KIF23; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23 and SULF2; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2 and PLK2; DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2 and EME1; and DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1 and BIN2.

In another embodiment, a post-operative radiation therapy outcome score (PORTOS) is calculated based on the levels of expression of the plurality of genes in the biological sample to determine whether or not the subject is likely to benefit from post-operative radiation therapy (see Examples). A PORTOS greater than 0 (i.e., high PORTOS) indicates that a subject will benefit from post-operative radiation therapy, whereas a PORTOS of less than or equal to 0 (i.e., low PORTOS) indicates that a subject will not benefit from post-operative radiation therapy.

In a further embodiment, the method is performed after the patient undergoes a radical prostatectomy. The method is preferably performed prior to treatment of the subject with radiation therapy to determine if the subject will benefit from radiation therapy or should be administered some other anti-cancer treatment. The method may also be performed while the subject is undergoing radiation therapy to help evaluate whether continued treatment is likely to be efficacious. Subjects, especially those identified as not likely to benefit from radiation therapy may be administered anti-cancer treatments other than radiation therapy such as, but not limited to, surgery, chemotherapy, immunotherapy, hormonal therapy, biologic therapy, or any combination thereof.

Targets

In some instances, assaying the expression level of a plurality of genes comprises detecting and/or quantifying a plurality of target analytes. In some embodiments, assaying the expression level of a plurality of genes comprises sequencing a plurality of target nucleic acids. In some embodiments, assaying the expression level of a plurality of biomarker genes comprises amplifying a plurality of target nucleic acids. In some embodiments, assaying the expression level of a plurality of biomarker genes comprises conducting a multiplexed reaction on a plurality of target analytes.

The methods disclosed herein often comprise assaying the expression level of a plurality of targets. The plurality of targets may comprise coding targets and/or non-coding targets of a protein-coding gene or a non-protein-coding gene. A protein-coding gene structure may comprise an exon and an intron. The exon may further comprise a coding sequence (CDS) and an untranslated region (UTR). The protein-coding gene may be transcribed to produce a pre-mRNA and the pre-mRNA may be processed to produce a mature mRNA. The mature mRNA may be translated to produce a protein.

A non-protein-coding gene structure may comprise an exon and intron. Usually, the exon region of a non-protein-coding gene primarily contains a UTR. The non-protein-coding gene may be transcribed to produce a pre-mRNA and the pre-mRNA may be processed to produce a non-coding RNA (ncRNA).

A coding target may comprise a coding sequence of an exon. A non-coding target may comprise a UTR sequence of an exon, intron sequence, intergenic sequence, promoter sequence, non-coding transcript, CDS antisense, intronic antisense, UTR antisense, or non-coding transcript antisense. A non-coding transcript may comprise a non-coding RNA (ncRNA).

In some instances, the plurality of targets comprises one or more targets selected from Table 1 or Table 2. In some instances, the plurality of targets comprises at least about 2, at least about 3, at least about 4, at least about 5, at least about 6, at least about 7, at least about 8, at least about 9, at least about 10, at least about 15, at least about 20, or at least about 24 targets selected from Table 2.

In some instances, the plurality of targets comprises a coding target, non-coding target, or any combination thereof. In some instances, the coding target comprises an exonic sequence. In other instances, the non-coding target comprises a non-exonic or exonic sequence. Alternatively, a non-coding target comprises a UTR sequence, an intronic sequence, antisense, or a non-coding RNA transcript. In some instances, a non-coding target comprises sequences which partially overlap with a UTR sequence or an intronic sequence. A non-coding target also includes non-exonic and/or exonic transcripts. Exonic sequences may comprise regions on a protein-coding gene, such as an exon, UTR, or a portion thereof. Non-exonic sequences may comprise regions on a protein-coding, non-protein-coding gene, or a portion thereof. For example, non-exonic sequences may comprise intronic regions, promoter regions, intergenic regions, a non-coding transcript, an exon anti-sense region, an intronic anti-sense region, UTR anti-sense region, non-coding transcript anti-sense region, or a portion thereof. In other instances, the plurality of targets comprises a non-coding RNA transcript.

The plurality of targets may comprise one or more targets selected from a classifier disclosed herein. The classifier may be generated from one or more models or algorithms. The one or more models or algorithms may be a Cox proportional hazards model, Naïve Bayes (NB), recursive Partitioning (Rpart), random forest (RF), support vector machine (SVM), k-nearest neighbor (KNN), high dimensional discriminate analysis (HDDA), or a combination thereof. The classifier may have an AUC of equal to or greater than 0.60. The classifier may have an AUC of equal to or greater than 0.61. The classifier may have an AUC of equal to or greater than 0.62. The classifier may have an AUC of equal to or greater than 0.63. The classifier may have an AUC of equal to or greater than 0.64. The classifier may have an AUC of equal to or greater than 0.65. The classifier may have an AUC of equal to or greater than 0.66. The classifier may have an AUC of equal to or greater than 0.67. The classifier may have an AUC of equal to or greater than 0.68. The classifier may have an AUC of equal to or greater than 0.69. The classifier may have an AUC of equal to or greater than 0.70. The classifier may have an AUC of equal to or greater than 0.75. The classifier may have an AUC of equal to or greater than 0.77. The classifier may have an AUC of equal to or greater than 0.78. The classifier may have an AUC of equal to or greater than 0.79. The classifier may have an AUC of equal to or greater than 0.80. The AUC may be clinically significant based on its 95% confidence interval (CI). The accuracy of the classifier may be at least about 70%. The accuracy of the classifier may be at least about 73%. The accuracy of the classifier may be at least about 75%. The accuracy of the classifier may be at least about 77%. The accuracy of the classifier may be at least about 80%. The accuracy of the classifier may be at least about 83%. The accuracy of the classifier may be at least about 84%. The accuracy of the classifier may be at least about 86%. The accuracy of the classifier may be at least about 88%. The accuracy of the classifier may be at least about 90%. The p-value of the classifier may be less than or equal to 0.05. The p-value of the classifier may be less than or equal to 0.04. The p-value of the classifier may be less than or equal to 0.03. The p-value of the classifier may be less than or equal to 0.02. The p-value of the classifier may be less than or equal to 0.01. The p-value of the classifier may be less than or equal to 0.008. The p-value of the classifier may be less than or equal to 0.006. The p-value of the classifier may be less than or equal to 0.004. The p-value of the classifier may be less than or equal to 0.002. The p-value of the classifier may be less than or equal to 0.001. The p-value of the classifier may be less than or equal to 0.0001.

The plurality of targets may comprise one or more targets selected from a Cox proportional hazards model. The plurality of targets may comprise two or more targets selected from a Cox proportional hazards model. The plurality of targets may comprise three or more targets selected from a Cox proportional hazards model. The plurality of targets may comprise 2, 3, 4, 5, 6, 7, 8, 9, 10, 11, 12, 13, 14, 15, 16, 17, 18, 19, 20, 21, 22, 23, 24, 25, 30, 35, 40, 45, 50, or more targets selected from a Cox proportional hazards model. The Cox proportional hazards model may be a ridge-penalized Cox model. Predictions from a Cox model can be described in terms of a binary score (i.e., PORTOS) as discussed in the Examples.

TABLE 1

PORTOS Target Sequences

| SEQ ID NO. | Affy Probeset ID | Gene | Sequence |
| --- | --- | --- | --- |
| 1 | 2378938 | DTL | AGATGCTGAAAAGAGAGTCGACTCC |
| 2 | 2378938 | DTL | CGGTTAGTCTCTCGCACTGCAGTCA |
| 3 | 2378938 | DTL | TCGACTCCGAAAAGGAGGCTGGGAC |
| 4 | 2378938 | DTL | CCTGCAGCGAGCCTTCGGTTAGTCT |
| 5 | 2378943 | DTL | GGAGGAAAACCTACATGGAAGAGAA |
| 6 | 2378943 | DTL | AGTCACGTCACCATTACTACTTGTG |
| 7 | 2378943 | DTL | CCTCTTTGTCCTCAGGGTCAAGGAG |
| 8 | 2378943 | DTL | ACTTGTGTGAAGAATACCTCTTTGT |
| 9 | 2378944 | DTL | AACAAGCTAACATATTGTGTCTTAG |
| 10 | 2378944 | DTL | ACCTTGTACATGATCGTCAACGGTT |
| 11 | 2378944 | DTL | GAGGGTTATACCTTGTACATGATCG |
| 12 | 2378944 | DTL | CGTCAACGGTTACTTCTTCCGAAAC |
| 13 | 2378945 | DTL | GTGACCTTACGGCAGAAACTGGACC |
| 14 | 2378945 | DTL | TACCTACCGAGTGACCTTACGGCAG |
| 15 | 2378945 | DTL | ACCTTACGGCAGAAACTGGACCGGA |
| 16 | 2378945 | DTL | ACCGAGTGACCTTACGGCAGAAACT |
| 17 | 2378946 | DTL | TCGGAGTTCAGTCAACGGAAAAGAT |
| 18 | 2378946 | DTL | TACGTTTCCAGTAGTTACGTCGGAG |
| 19 | 2378946 | DTL | CCTGCATTTTCGACCACTCGACTAA |
| 20 | 2378946 | DTL | ACCTTGTACGTTTCCAGTAGTTACG |
| 21 | 2378952 | DTL | CCGTTGTAATACCAGACCCTATGGT |
| 22 | 2378952 | DTL | ACCGTTGTAATACCAGACCCTATGG |
| 23 | 2378952 | DTL | TACCGTTGTAATACCAGACCCTATG |
| 24 | 2378952 | DTL | CGTTGTAATACCAGACCCTATGGTC |
| 25 | 2378953 | DTL | TTATGGAGTCTGTTCGTTTGGGGAA |
| 26 | 2378953 | DTL | GTTCACTTAGTTTAGTCACCTCGAG |
| 27 | 2378953 | DTL | ATATCCGTTCACTTAGTTTAGTCAC |
| 28 | 2378953 | DTL | GTTTAGTCACCTCGAGTGTTATGGA |
| 29 | 2378954 | DTL | CACCAGGAGAAAGTTCTGCTCTTAT |
| 30 | 2378954 | DTL | CTTATGGAATCAGAGTCGTCCTCGA |
| 31 | 2378954 | DTL | GGAGAAAGTTCTGCTCTTATGGAAT |
| 32 | 2378954 | DTL | AAGGTCGTTTCACAATGACACCAGG |
| 33 | 2378956 | DTL | AGATGAAATAAACGATTAACGTGTC |
| 34 | 2378956 | DTL | AACGTGTCTGCTATTGTAGATGTAC |
| 35 | 2378956 | DTL | CTATAAGTTCAGACTAAAACCTAAG |
| 36 | 2378956 | DTL | GTAGATGTACAAATTATACTGACCC |
| 37 | 2378957 | DTL | ATACATTTTAGGTCGGAATCAGGTC |
| 38 | 2378957 | DTL | TCAAAATCAGTCACCGAGTTCACT |
| 39 | 2378957 | DTL | TTAGGTCGGAATCAGGTCTACTGGT |
| 40 | 2378957 | DTL | ACCGATAAAAGTTACCTGTGGTCTT |
| 41 | 2378959 | DTL | CGACCACAGGTAGACTGAAGTGTTT |
| 42 | 2378959 | DTL | CCAGTAAGAGTTCTCCAGTGCAGAC |
| 43 | 2378959 | DTL | GTGGGACCGTTGGAGGATGACACGA |
| 44 | 2378959 | DTL | AGGTGTGGGACCGTTGGAGGATGAC |
| 45 | 2378960 | DTL | TATTAATAGGTCAGTGTTCCGGAAT |
| 46 | 2378960 | DTL | CTCAGTCGAAACAACCTTTAGACCT |
| 47 | 2378960 | DTL | AGATATAGGACAAATAATCTGTTTT |
| 48 | 2378960 | DTL | TGTTCCGGAATTCTGTGTGGACAAA |
| 49 | 2378961 | DTL | GACCGCGAACTTATCTCCGAATCTC |
| 50 | 2378961 | DTL | TTAGACCGCGAACTTATCTCCGAAT |
| 51 | 2378961 | DTL | GCGAACTTATCTCCGAATCTCCTCT |
| 52 | 2378961 | DTL | TTTTTAGACCGCGAACTTATCTCCG |
| 53 | 2378963 | DTL | AGTCTTTCGACACCTTGCGATGGAG |
| 54 | 2378963 | DTL | ACACGACGGAACGACCATTGGTCCT |
| 55 | 2378963 | DTL | GGTGGACGAAGCCTCTGGTTCTAGT |
| 56 | 2378963 | DTL | CAGAGGATAGTCAGGCATACGAAGT |
| 57 | 2378968 | DTL | GTATGAAGGTATCTTTCAGGGTCCT |
| 58 | 2378968 | DTL | GACGTGTATGAAGGTATCTTTCAGG |
| 59 | 2378968 | DTL | AAGACACCAGGACTTGTGAGTTGTC |
| 60 | 2378968 | DTL | AGGACTTGTGAGTTGTCTTAATATC |
| 61 | 2378969 | DTL | ACCCACGGTTTCCAGTTGACATTAC |

TABLE 1-continued

PORTOS Target Sequences

| SEQ ID NO. | Affy Probeset ID | Gene | Sequence |
|---|---|---|---|
| 62 | 2378969 | DTL | GGGACTCCTGACACATCTGAAATAC |
| 63 | 2378969 | DTL | AAGTCCACGTCAGTAGTCAAGAAAT |
| 64 | 2378969 | DTL | GACCCATATTGTACAGAGTGAACCT |
| 65 | 2378970 | DTL | AGATGTTTTTCTTGATATCATCAG |
| 66 | 2378970 | DTL | ACTCGAAAAACGTAATGGATCTTCG |
| 67 | 2378970 | DTL | CGTAATGGATCTTCGTCAGATGTTT |
| 68 | 2378970 | DTL | TCGAAAAACGTAATGGATCTTCGTC |
| 69 | 2378972 | DTL | ACGTCAGACGTTTCCAGAAGTGTTT |
| 70 | 2428797 | PTPN22 | AAAACGGATTTACCTCATATGGAAC |
| 71 | 2428797 | PTPN22 | CATGTTACATAGGTTGTCTGTGAGT |
| 72 | 2428797 | PTPN22 | TAAGGGACTGTCAATAAAAACGGAT |
| 73 | 2428797 | PTPN22 | CCCAACGTTATGTTTGACGAGAACT |
| 74 | 2428798 | PTPN22 | ATTCACGGTCAAAACGTAAAAGTAT |
| 75 | 2428798 | PTPN22 | CGTTTTACGGTTATTCACGGTCAAA |
| 76 | 2428798 | PTPN22 | TACTTCTATACGATTACACAATTAT |
| 77 | 2428798 | PTPN22 | ATTCACGAGATATACGTATTATAGT |
| 78 | 2428799 | PTPN22 | TCCTTAGGTGGTGGTTAACCTTAT |
| 79 | 2428799 | PTPN22 | GTTCCTTAGGTGGTGGTTAACCTT |
| 80 | 2428799 | PTPN22 | CTTAGGTGGTGGTTAACCTTATAA |
| 81 | 2428799 | PTPN22 | GGTTCCTTAGGTGGTGGTTAACCT |
| 82 | 2428800 | PTPN22 | AAGAACGGGTGGTTTGTTCGGACGT |
| 83 | 2428800 | PTPN22 | ACAAGTCAGTTTATTGAGGTCGAGT |
| 84 | 2428800 | PTPN22 | AGTTTATTGAGGTCGAGTAAAGACT |
| 85 | 2428800 | PTPN22 | GAACGGGTGGTTTGTTCGGACGTCT |
| 86 | 2428801 | PTPN22 | AGACTCAGACAGAAATCAGAAAGGG |
| 87 | 2428801 | PTPN22 | CACTAGACTAGTTGTCAGTAGACTC |
| 88 | 2428801 | PTPN22 | GAATTGTTAATATACACTAGACTAG |
| 89 | 2428801 | PTPN22 | CATTCGTGGATGTAAAACAATTGTA |
| 90 | 2428806 | PTPN22 | ACTTCTGAGGACCTTTTTCAAAGTG |
| 91 | 2428806 | PTPN22 | CTTCTGAGGACCTTTTTCAAAGTGT |
| 92 | 2428806 | PTPN22 | TCTGAGGACCTTTTTCAAAGTGTTC |
| 93 | 2428806 | PTPN22 | GACTTCTGAGGACCTTTTTCAAAGT |
| 94 | 2428809 | PTPN22 | ATAAAGACCGAAAGGGTCTGATCTT |
| 95 | 2428809 | PTPN22 | CAATTCAAATCTCATTAAGTGAAGT |
| 96 | 2428809 | PTPN22 | AGTGAAGTCCTTCAATGAACCAAGG |
| 97 | 2428809 | PTPN22 | CCAAGGGTATTATCGAAGGTCATAA |
| 98 | 2428810 | PTPN22 | ACATTTTGAGGCTTCAGGATTTAGT |
| 99 | 2428811 | PTPN22 | CTTCCATTTTTAACCTTGTAGTGAC |
| 100 | 2428811 | PTPN22 | ACTACTGAGACACTATGAATCTGGT |
| 101 | 2428811 | PTPN22 | ACCCCACCTTGTAGACTTGGTTTCT |
| 102 | 2428811 | PTPN22 | GAGACACTATGAATCTGGTTCGTTC |
| 103 | 2428814 | PTPN22 | GGTGAAGGACATACCTGTGGACTTA |
| 104 | 2428814 | PTPN22 | GGACTTAGTAAATAACACCAACTCC |
| 105 | 2428814 | PTPN22 | GACATACCTGTGGACTTAGTAAATA |
| 106 | 2428814 | PTPN22 | AAGGACATACCTGTGGACTTAGTAA |
| 107 | 2428815 | PTPN22 | GGTACTGAGATCACGAGAACCACAT |
| 108 | 2428815 | PTPN22 | TCTCGATCAAAACGTGGGACGATTT |
| 109 | 2428815 | PTPN22 | AGTAGTACCGGAGGTTCACCATGGT |
| 110 | 2428815 | PTPN22 | GGTTATCAACCCCTCGGAGAAGTCT |
| 111 | 2428817 | PTPN22 | ATCTTGATAAATTCTCTGTCTACCT |
| 112 | 2428817 | PTPN22 | TCTCTGTCTACCTACAATAGTCTCT |
| 113 | 2428817 | PTPN22 | CCAGATGTTACGACATAATCTTGAT |
| 114 | 2428817 | PTPN22 | ACTTGACCAGATGTTACGACATAAT |
| 115 | 2428818 | PTPN22 | GTCTCCGGAAGTAATCAAGTTTGCG |
| 116 | 2428818 | PTPN22 | CAAAAGTCAAACTAGGCCCTTTACG |
| 117 | 2428818 | PTPN22 | CTCCGGAAGTAATCAAGTTTGCGTC |
| 118 | 2428818 | PTPN22 | GCCCTTTACGCCTGTGTCTCCGGAA |
| 119 | 2428819 | PTPN22 | ACGATAACTAATATGTACCTACAAC |
| 120 | 2428819 | PTPN22 | AACTAATATGTACCTACAACGATTT |
| 121 | 2428819 | PTPN22 | ACACGATAACTAATATGTACCTACA |
| 122 | 2428819 | PTPN22 | GATAACTAATATGTACCTACAACGA |
| 123 | 2428821 | PTPN22 | AGTAGACCCTACATGCAACAATGGT |
| 124 | 2428821 | PTPN22 | CTACTGTCACAAGGGTATACGTAAG |
| 125 | 2428821 | PTPN22 | ATATCTGGGATAAGAACTCGAGTAG |
| 126 | 2428821 | PTPN22 | CTACATGAAGTAGATATCTGGGAT |
| 127 | 2428823 | PTPN22 | GACTAATATATTAGTCCTGAGATTT |
| 128 | 2428823 | PTPN22 | CTAATATATTAGTCCTGAGATTTTC |
| 129 | 2428823 | PTPN22 | ATATATTAGTCCTGAGATTTTCAAT |
| 130 | 2428823 | PTPN22 | ATATTAGTCCTGAGATTTTCAATTC |
| 131 | 2428826 | PTPN22 | ACAATACCGTACGTACCTCATACTT |
| 132 | 2428826 | PTPN22 | ATACCGTACGTACCTCATACTTTAC |
| 133 | 2428826 | PTPN22 | TACGTACCTCATACTTTACCCTTTC |
| 134 | 2428826 | PTPN22 | AGTAACAATACCGTACGTACCTCAT |
| 135 | 2428828 | PTPN22 | AGGGACTATTGGAGACTACTCCTAA |

TABLE 1-continued

PORTOS Target Sequences

| SEQ ID NO. | Affy Probeset ID | Gene | Sequence |
|---|---|---|---|
| 136 | 2428828 | PTPN22 | TATCGGCCCATCTTGATAGGGACTA |
| 137 | 2428828 | PTPN22 | CTAATATCGGCCCATCTTGATAGGG |
| 138 | 2428828 | PTPN22 | CTTGATAGGGACTATTGGAGACTAC |
| 139 | 2428829 | PTPN22 | GATAGGATGTTGACACCGACTCTTC |
| 140 | 2428829 | PTPN22 | CCGTCTGTTTTGGATAGGATGTTGA |
| 141 | 2428829 | PTPN22 | GTTAGATGGTTCATGTTCCGTCTGT |
| 142 | 2428829 | PTPN22 | TTTCCGTTAGATGGTTCATGTTCCG |
| 143 | 2428831 | PTPN22 | TACCTGGTTTCTCTTTAAGACGTCT |
| 144 | 2428831 | PTPN22 | TCTCCTCAAACGGTTACTTAAAGAC |
| 145 | 2428831 | PTPN22 | TTAATGATTTCTCCTCAAACGGTTA |
| 146 | 2428831 | PTPN22 | CTACTCCGGGTTTCGTTCTTTTAAT |
| 147 | 2482925 | RPS27A | CGCAGACCATCTAACGACTAAGAGA |
| 148 | 2482925 | RPS27A | CGGGTTCCTCGCAGACCATCTAACG |
| 149 | 2482925 | RPS27A | CCTCGCAGACCATCTAACGACTAAG |
| 150 | 2482925 | RPS27A | CGTCCCTCCGCGATGTCCTCTCTTT |
| 151 | 2482926 | RPS27A | ATCGGTGCAACTAACATGCCCTTTT |
| 152 | 2482926 | RPS27A | AAGAGAATCGGTGCAACTAACATGC |
| 153 | 2482926 | RPS27A | GAGAATCGGTGCAACTAACATGCCC |
| 154 | 2482926 | RPS27A | GTGCAACTAACATGCCCTTTTCGGA |
| 155 | 2482927 | RPS27A | AAAGCTTTCGTAAGGCTTCCGATTT |
| 156 | 2482928 | RPS27A | AGCGACCCTGCCGTCAGTCCGTAAA |
| 157 | 2482928 | RPS27A | TGCTTCAAGTGCAGGATCAGACCGT |
| 158 | 2482928 | RPS27A | AGACCGTGGCCCAACCTAACAGCGA |
| 159 | 2482928 | RPS27A | CCTCTCCTCTTTGCTTCAAGTGCAG |
| 160 | 2482929 | RPS27A | AGAACACTAGGGACTGGATTGGACA |
| 161 | 2482929 | RPS27A | CGACGAGAGCCCAATCGTGGGATAC |
| 162 | 2482929 | RPS27A | AGACGTGAAGCCGACGAGAGCCCAA |
| 163 | 2482929 | RPS27A | CGTGGGATACCACGGAAGAGAACAC |
| 164 | 2482931 | RPS27A | AAACGACTCGTTGCTGGATCTCCAC |
| 165 | 2482931 | RPS27A | TGGACAGAGGAGAGCTCCCCAAGGT |
| 166 | 2482931 | RPS27A | TCGGTTCCAGGCTTATTCCAGGACT |
| 167 | 2482931 | RPS27A | CAGAATCTGGTACTAAGGCTTAAAC |
| 168 | 2482934 | RPS27A | TCACTCACCGCGTCAGTGACGTTGG |
| 169 | 2482934 | RPS27A | GTAAGCTTATCGTCATCTAAAAATC |
| 170 | 2482934 | RPS27A | CCTTTTACCGTAAGCTTATCGTCAT |
| 171 | 2482934 | RPS27A | CTCACTCACCGCGTCAGTGACGTTG |
| 172 | 2482935 | RPS27A | TACAGGGATATTTGACAGTCAATTC |
| 173 | 2482935 | RPS27A | CATAGGGTACCACATTACATTACGT |
| 174 | 2482935 | RPS27A | ACTCTTCGTGACGATATCAAGAGGG |
| 175 | 2482935 | RPS27A | GAGGGTAATACTTAAAACGTTCAAC |
| 176 | 2482936 | RPS27A | ACTTTCGAACGAAGTAAGAAGGTAA |
| 177 | 2482936 | RPS27A | ACCTTAGTACTTTCGAACGAAGTAA |
| 178 | 2482936 | RPS27A | CGAACGAAGTAAGAAGGTAATTGTC |
| 179 | 2482936 | RPS27A | TAGTACTTTCGAACGAAGTAAGAAG |
| 180 | 2482937 | RPS27A | TCTTCTTCAGAATGTGGTGAGGGTT |
| 181 | 2482937 | RPS27A | CGTGTTCTCTTTCTTCCAATTCGAC |
| 182 | 2482937 | RPS27A | ACAACTCTGAAGCACCACCACGATT |
| 183 | 2482937 | RPS27A | CAATTCGACCGACAGGACTTTATAA |
| 184 | 2482940 | RPS27A | CAAATACCGTTCAGTGAAACTGTCT |
| 185 | 2482940 | RPS27A | ACCGTTTTAATCAGCGGAAGCAGCT |
| 186 | 2482940 | RPS27A | GCGGAAGCAGCTCTCACGGGAAGAC |
| 187 | 2482940 | RPS27A | ACAGACTGAATGACAAAGTTGTTTG |
| 188 | 2482941 | RPS27A | CGATAGCGACACACTTACAACGGAG |
| 189 | 2482941 | RPS27A | GTCCACGGTTGGTGAACATTTCCAG |
| 190 | 2482941 | RPS27A | GGTCACCAAGACATATGGACGGTCC |
| 191 | 2482941 | RPS27A | AACGGAGACCCCTAATACACTGGGT |
| 192 | 2482944 | RPS27A | AGTCGGGACAGCGACCAAGCCAAGT |
| 193 | 2482944 | RPS27A | CCATTAACAGTTTGATTTACTCAAG |
| 194 | 2482944 | RPS27A | TTTACTCAAGACGACATCAAGGAAT |
| 195 | 2482944 | RPS27A | GGAATTACACATTGGTTGTACGAAA |
| 196 | 2482946 | RPS27A | TGAACGCACTTAAACCTGTGAATAA |
| 197 | 2482946 | RPS27A | ATGGATCTAACCTTAGGAACTCCAC |
| 198 | 2482946 | RPS27A | CGTGTCATGGATCTAACCTTAGGAA |
| 199 | 2482946 | RPS27A | CTCCACATAAAGTGAACGCACTTAA |
| 200 | 2508612 | ARHGAP15 | CAAAGTTATTGTCCAGTAACGGCTC |
| 201 | 2508612 | ARHGAP15 | TGTCCGGATGAGAATGCTGTACACT |
| 202 | 2508612 | ARHGAP15 | TAATTGTCAATCCTCAACTACCGTC |
| 203 | 2508612 | ARHGAP15 | AATTCGTCGTAGGTTGTGTCCGGAT |
| 204 | 2508620 | ARHGAP15 | TCCTTAGTAAGTGTCGTATAGAACT |
| 205 | 2508620 | ARHGAP15 | TTAGTAAGTGTCGTATAGAACTTTC |
| 206 | 2508620 | ARHGAP15 | TTCCTTAGTAAGTGTCGTATAGAAC |
| 207 | 2508620 | ARHGAP15 | CCTTAGTAAGTGTCGTATAGAACTT |
| 208 | 2508622 | ARHGAP15 | ACCAACTTTTTCTTCCAATAGACGT |
| 209 | 2508627 | ARHGAP15 | ACTTAATTCGTTACTGTGTACTCCG |

TABLE 1-continued

PORTOS Target Sequences

| SEQ ID NO. | Affy Probeset ID | Gene | Sequence |
|---|---|---|---|
| 210 | 2508627 | ARHGAP15 | CTTAATTCGTTACTGTGTACTCCGA |
| 211 | 2508627 | ARHGAP15 | AACTTAATTCGTTACTGTGTACTCC |
| 212 | 2508627 | ARHGAP15 | AAACTTAATTCGTTACTGTGTACTC |
| 213 | 2508628 | ARHGAP15 | TTCTTAGGTTCGTTGTCCGAGACAG |
| 214 | 2508628 | ARHGAP15 | TTTCTTAGGTTCGTTGTCCGAGACA |
| 215 | 2508628 | ARHGAP15 | AACAAGAAAGATCAGCTTCTTAACT |
| 216 | 2508628 | ARHGAP15 | GAAAGATCAGCTTCTTAACTTAAAA |
| 217 | 2508633 | ARHGAP15 | CACGTAAGAACATGCACTCCACAAA |
| 218 | 2508633 | ARHGAP15 | CGACCACGTAAGAACATGCACTCCA |
| 219 | 2508633 | ARHGAP15 | CCACGTAAGAACATGCACTCCACAA |
| 220 | 2508633 | ARHGAP15 | GACCACGTAAGAACATGCACTCCAC |
| 221 | 2508634 | ARHGAP15 | TTTGACCCGTGTTTGGTCTTTCACA |
| 222 | 2508634 | ARHGAP15 | TTTTGACCCGTGTTTGGTCTTICAC |
| 223 | 2508634 | ARHGAP15 | TCCTTTTTAGCTCGTCTTTCTTACA |
| 224 | 2508674 | ARHGAP15 | GTATCAAAGAAATGGACAGATAAAG |
| 225 | 2508674 | ARHGAP15 | AACCTCATTAAGTCGAGATCGGGAT |
| 226 | 2508674 | ARHGAP15 | ATCTCTCGCCAAGTTTTACGAGGGT |
| 227 | 2508674 | ARHGAP15 | CGGGATGAGACTGAATTAGCAAGAT |
| 228 | 2508675 | ARHGAP15 | AGTAGTATAACCTAACCAAGGTGCG |
| 229 | 2508675 | ARHGAP15 | GGTGCGATAGTTTTTACGTTAACTG |
| 230 | 2508675 | ARHGAP15 | CTCAAGGAAGATGTCAGTCTATAAC |
| 231 | 2508675 | ARHGAP15 | GTGTTGTCATAGTCCTTTACTCAAG |
| 232 | 2508676 | ARHGAP15 | AGGAGATCGTGACTTAACGATTCAG |
| 233 | 2508676 | ARHGAP15 | AAGTTTTAGGTTTCTAGGAGATCGT |
| 234 | 2508676 | ARHGAP15 | ACGATTCAGTGATGCTGTCACTATA |
| 235 | 2508676 | ARHGAP15 | GGTAGTTCTTTGGACCTTAATAAGT |
| 236 | 2508677 | ARHGAP15 | GAACGAGTAAAATTCAAACAGATTT |
| 237 | 2508677 | ARHGAP15 | ACGAGTAAAATTCAAACAGATTTAC |
| 238 | 2508677 | ARHGAP15 | TGAACGAGTAAAATTCAAACAGATT |
| 239 | 2508677 | ARHGAP15 | CGAGTAAAATTCAAACAGATTTACG |
| 240 | 2508678 | ARHGAP15 | CTAAACACGTGACCTCCCGTCAGAC |
| 241 | 2508678 | ARHGAP15 | AGTATGAGTACCTTCTAAGCATCGG |
| 242 | 2508678 | ARHGAP15 | ATCGGTAAAGGACCGGTCCCTAAAC |
| 243 | 2508678 | ARHGAP15 | GTAGTAACAACCATTACGGAAAACT |
| 244 | 2508691 | ARHGAP15 | CTATGTTCGCTGTTTTTAGCTCAAT |
| 245 | 2508691 | ARHGAP15 | ACAAGTCTGACGTAGTGTCACGAAG |
| 246 | 2508691 | ARHGAP15 | GCTGTTTTTAGCTCAATTTTCGTCT |
| 247 | 2508691 | ARHGAP15 | GTGTCACGAAGGCTATGTTCGCTGT |
| 248 | 2508699 | ARHGAP15 | AAACATTTCGTTACGTAACTTCGAC |
| 249 | 2508699 | ARHGAP15 | ACGTGTTTCACACACTTGCACTTTT |
| 250 | 2508699 | ARHGAP15 | AGGTGTCAAGGCACCAAACATTTCG |
| 251 | 2508699 | ARHGAP15 | GTGTTTCACACACTTGCACTTTTAA |
| 252 | 2508700 | ARHGAP15 | GGAGATGTGTTGGTTATGAGTTCAA |
| 253 | 2508700 | ARHGAP15 | ACGGTGGACTAAACAGACTCTTCGG |
| 254 | 2508700 | ARHGAP15 | GAGTTCAATCGTCACGGTGGACTAA |
| 255 | 2508700 | ARHGAP15 | ACACGTCGTCAAGGGGGTAATGAC |
| 256 | 2508706 | ARHGAP15 | CAGATCTACAACTACCTTATATAGC |
| 257 | 2508706 | ARHGAP15 | AGCTCAATCACCGTTAGACCGTTGT |
| 258 | 2508706 | ARHGAP15 | ATCACCGTTAGACCGTTGTTATGTC |
| 259 | 2508706 | ARHGAP15 | CCTTATATAGCTCAATCACCGTTAG |
| 260 | 2508711 | ARHGAP15 | GGTCGGGAAGATAGTCTTGACCTAC |
| 261 | 2508711 | ARHGAP15 | TCTTGACCTACCTCTGGACACCTGT |
| 262 | 2508711 | ARHGAP15 | CGGGAAGATAGTCTTGACCTACCTC |
| 263 | 2508711 | ARHGAP15 | AGACCTTATGGTCGGGAAGATAGTC |
| 264 | 2508712 | ARHGAP15 | GACGTCTAAAAAGTGTCACCAGTAA |
| 265 | 2508712 | ARHGAP15 | TGGAGGTCTCGTTCGGTTATTAAAC |
| 266 | 2508712 | ARHGAP15 | TCACCAGTAAACTGGAGGTCTCGTT |
| 267 | 2508712 | ARHGAP15 | CGACGTCTAAAAAGTGTCACCAGTA |
| 268 | 2508716 | ARHGAP15 | TCACCTAACCTCTGGTAGTGGAAAG |
| 269 | 2508716 | ARHGAP15 | TTCACCTAACCTCTGGTAGTGGAAA |
| 270 | 2508716 | ARHGAP15 | ACCTAACCTCTGGTAGTGGAAAGAG |
| 271 | 2508716 | ARHGAP15 | CACCTAACCTCTGGTAGTGGAAAGA |
| 272 | 2508717 | ARHGAP15 | GGTTTCCTGGACACTAGAGTGGACG |
| 273 | 2508717 | ARHGAP15 | TTAACCTGGTGATGTCCGAGACTGG |
| 274 | 2508717 | ARHGAP15 | ACTAGGGTTGGTTTGTATCACTTCC |
| 275 | 2508717 | ARHGAP15 | CCGAGACTGGTGTACATACTCTTCG |
| 276 | 2508718 | ARHGAP15 | TCGAAGTCTCCAGGCTTAAACCGGT |
| 277 | 2508718 | ARHGAP15 | CTGAAGCCGGCAATTCTAAACGAAG |
| 278 | 2508718 | ARHGAP15 | GACCCTCTGAGCACGAGACATTCGT |
| 279 | 2508718 | ARHGAP15 | TAGTACGACTGTATCTCCGTGGAAC |
| 280 | 2508719 | ARHGAP15 | TTGTAAGAGTTTTCCCGTGTCCGGG |
| 281 | 2508719 | ARHGAP15 | GACCAGCAGATAACACAGTCTTTCG |
| 282 | 2508719 | ARHGAP15 | GACAGTTCATCAGTGTGCCTTTAAT |
| 283 | 2508719 | ARHGAP15 | GATTGATTAACTTGATGACCAGCAG |

TABLE 1-continued

PORTOS Target Sequences

| SEQ ID NO. | Affy Probeset ID | Gene | Sequence |
|---|---|---|---|
| 284 | 2508725 | ARHGAP15 | CCTGTAGGTGCAACAGTGGCCTCGT |
| 285 | 2508725 | ARHGAP15 | TCGACTTAAACCTGCTGTCGGTCAC |
| 286 | 2508725 | ARHGAP15 | ACTCGGCGAGAAGGGAATGTCAAAG |
| 287 | 2508725 | ARHGAP15 | GTGGCCTCGTGACTTCTACAAAAAG |
| 288 | 2508741 | ARHGAP15 | GAGGCGGTTTAGCACTGTGGTACTT |
| 289 | 2508741 | ARHGAP15 | AGAACATGTTTTTGAGGGAGGCGGT |
| 290 | 2508741 | ARHGAP15 | TAACTTCGACATTTTAGAGAACATG |
| 291 | 2508741 | ARHGAP15 | GCGGTTTAGCACTGTGGTACTTTCA |
| 292 | 2508742 | ARHGAP15 | ACGCATGTAGAGCATAAAAGGGAAC |
| 293 | 2508742 | ARHGAP15 | CATGGTGCACGACCCCGGTGTTTAT |
| 294 | 2508742 | ARHGAP15 | GGGAACATCGACTTGATCCAGAAAG |
| 295 | 2508742 | ARHGAP15 | ACGAACAGTCTTGGTAGCGGACCTG |
| 296 | 2508746 | ARHGAP15 | GTCTTTTCGTGAGGTAAAAACGTCT |
| 297 | 2508746 | ARHGAP15 | GAATTACGCCGTGTCAACCTGATCT |
| 298 | 2508746 | ARHGAP15 | AAGGTGAACTGGATGCATGAGATGT |
| 299 | 2508746 | ARHGAP15 | CCCTTACATTACTTCACGGTTTTTA |
| 300 | 2508762 | ARHGAP15 | CTTTGTACCGCTAGGTGTACCAGAT |
| 301 | 2508762 | ARHGAP15 | CGAACCCCTAACATAAACCTGGATG |
| 302 | 2508762 | ARHGAP15 | ACCAGATGGTCTTGGTCTATCGACT |
| 303 | 2508762 | ARHGAP15 | AACCTGGATGGGAAGACGCTCGACT |
| 304 | 2508763 | ARHGAP15 | ATTCTAGAAGCCGAGTCTCCTTCTG |
| 305 | 2508763 | ARHGAP15 | CATTCTAGAAGCCGAGTCTCCTTCT |
| 306 | 2508763 | ARHGAP15 | TCTAGAAGCCGAGTCTCCTTCTGAC |
| 307 | 2508763 | ARHGAP15 | CTAGAAGCCGAGTCTCCTTCTGACT |
| 308 | 2508764 | ARHGAP15 | CGATGACTTATGCAAGTGTAGACAG |
| 309 | 2508764 | ARHGAP15 | ATGTAAAGACATTTGTATAAAGACT |
| 310 | 2508764 | ARHGAP15 | GAAAGTTCGCTGTCTACGGAGTAAA |
| 311 | 2508764 | ARHGAP15 | AACACAAATTCAAGGTTTGTAAACT |
| 312 | 2571511 | IL1B | GGTGTAAGACTACTCGTTGGCGAAG |
| 313 | 2571511 | IL1B | CCTGAGTTAGGGATCCCGACCGTCT |
| 314 | 2571511 | IL1B | CGGGAAAACAACTCGGTCCGGAGAG |
| 315 | 2571511 | IL1B | TTCTCCTAGAGGACAGGTAGTCGGT |
| 316 | 2571512 | IL1B | GGTTTCCGCCGGTCCTATATTGACT |
| 317 | 2571512 | IL1B | TTGACTGAAGTGGTACGTTAAACAC |
| 318 | 2571512 | IL1B | TTGTACGGGCAGAAGGACCCTCCCT |
| 319 | 2571512 | IL1B | GACCTAAACTCAGACGGGTCAAGG |
| 320 | 2571513 | IL1B | GCGGGGGTAGGGATCCTTTTCGACC |
| 321 | 2571513 | IL1B | TTACGATACCTTACTTCGGGAAGAG |
| 322 | 2571513 | IL1B | ACTTACGATACCTTACTTCGGGAAG |
| 323 | 2571513 | IL1B | AACTGTTAAAACGTAATTACATTTA |
| 324 | 2571514 | IL1B | AGGACGCACAACTTTCTACTATTCG |
| 325 | 2571514 | IL1B | CCACAAGAGGTACAGGAAACATGTT |
| 326 | 2571514 | IL1B | TAGACATGGACAGGACGCACAACTT |
| 327 | 2571514 | IL1B | ACTATTCGGGTGAGATGTCGACCTC |
| 328 | 2571517 | IL1B | CGTGCTACGTGGACATGCTAGTGAC |
| 329 | 2571517 | IL1B | ATTGCTCCGAATACACGTGCTACGT |
| 330 | 2571517 | IL1B | AGACCAGGTATACTTGACTTTCGAG |
| 331 | 2571517 | IL1B | AGTGACTTGACGTGCGAGGCCCTGA |
| 332 | 2571518 | IL1B | GGAGGGACACCCGATCACAATACTG |
| 333 | 2571518 | IL1B | CGACCTTGGGTACAGATTATCACAG |
| 334 | 2571518 | IL1B | GTCCCCGGAAAGTGAATGTAACAGT |
| 335 | 2571518 | IL1B | ATTCATCGAGACAACGAGCCGGTGT |
| 336 | 2571519 | IL1B | GTCCGGCGCAGTCAACAACACCGGT |
| 337 | 2571519 | IL1B | CCTACCGCCGTAGGTCGATGCTTAG |
| 338 | 2571519 | IL1B | CGCAGTCAACAACACCGGTACCTGT |
| 339 | 2571519 | IL1B | ATGCTTAGAGGCTGGTGGTGATGTC |
| 340 | 2571520 | IL1B | CCTACTGAACAAGAAACTTCGACTA |
| 341 | 2571520 | IL1B | CGTTACTCCTACTGAACAAGAAACT |
| 342 | 2571520 | IL1B | TACTCCTACTGAACAAGAAACTTCG |
| 343 | 2571520 | IL1B | CTCCTACTGAACAAGAAACTTCGAC |
| 344 | 2571522 | IL1B | TCATGGACTCGAGCGGTCACTTTAC |
| 345 | 2571522 | IL1B | GCGGTCACTTTACTACCGAATAATG |
| 346 | 2571522 | IL1B | TGGACTCGAGCGGTCACTTTACTAC |
| 347 | 2571522 | IL1B | TCGAGCGGTCACTTTACTACCGAAT |
| 348 | 2571523 | IL1B | CAGTACCCCTTCAGTGAGTAAAAGA |
| 349 | 2571523 | IL1B | CGGCAGTACCCCTTCAGTGAGTAAA |
| 350 | 2571523 | IL1B | ACTTGCATCGGCAGTACCCCTTCAG |
| 351 | 2571523 | IL1B | CTTTAGTGTGTACTTGCATCGGCAG |
| 352 | 2571524 | IL1B | TATAAGACCCTTACCTATGACGAAT |
| 353 | 2571524 | IL1B | GAATACTGAGCCCTTTATAAGACCC |
| 354 | 2571524 | IL1B | TTCCAATACAGTTTCGGAGACGAG |
| 355 | 2571524 | IL1B | GTTGATCCACGATTCCCTCAGAGAG |
| 356 | 2571525 | IL1B | CGGTATTTTGTCGCTCCCTCTTTG |
| 357 | 2571525 | IL1B | TGGAGAAGCTCCGTGTTCCGTGTTG |

TABLE 1-continued

PORTOS Target Sequences

| SEQ ID NO. | Affy Probeset ID | Gene | Sequence |
|---|---|---|---|
| 358 | 2571525 | IL1B | TCTATGGTTTGGAGAAGCTCCGTGT |
| 359 | 2571525 | IL1B | GGTTTGGAGAAGCTCCGTGTTCCGT |
| 360 | 2674763 | UBA7 | ATCGAGTTACCTCGGGGCCTAGGGT |
| 361 | 2674763 | UBA7 | TACCTCGGGGCCTAGGGTTCGGGAC |
| 362 | 2674763 | UBA7 | ACAGTGGATCGAGTTACCTCGGGGC |
| 363 | 2674763 | UBA7 | GTGGGACAGTGGATCGAGTTACCTC |
| 364 | 2674764 | UBA7 | CACTGCTGCTCCTGTGACGGAAGGG |
| 365 | 2674764 | UBA7 | CCGTCGCCCACAACCACGATCTCGA |
| 366 | 2674764 | UBA7 | CGTCGCCCACAACCACGATCTCGAC |
| 367 | 2674766 | UBA7 | GCCTACCAGTGGACTTTTCGTCCGG |
| 368 | 2674766 | UBA7 | TACGCCGGCCTACCAGTGGACTTTT |
| 369 | 2674766 | UBA7 | GTCGGGACGAGATACGCCGGCCTAC |
| 370 | 2674766 | UBA7 | TGGACTTTTCGTCCGGGTCGTGGAC |
| 371 | 2674767 | UBA7 | CACACGGGACAACGATGGGGTTGGG |
| 372 | 2674767 | UBA7 | GACCACAGACTGGAAAGAGGAGATC |
| 373 | 2674767 | UBA7 | ACGGGACAACGATGGGGTTGGGGGT |
| 374 | 2674767 | UBA7 | TCGACCACAGACTGGAAAGAGGAGA |
| 375 | 2674768 | UBA7 | CTGGCAGACTTCCATGGTCGACCCG |
| 376 | 2674768 | UBA7 | GTGGACTTCACCTGGAGAACCCTGG |
| 377 | 2674768 | UBA7 | CCTCAGCGACGACCGAGTAGAAGTC |
| 378 | 2674768 | UBA7 | TCACCTGGAGAACCCTGGCAGACTT |
| 379 | 2674772 | UBA7 | GCCGTCGATCGGACTCTACAGTCTT |
| 380 | 2674772 | UBA7 | CTAAGGTGGCCAGTTGGCACGGGTC |
| 381 | 2674772 | UBA7 | CTGAAACACCATCGCCGTCGATCGG |
| 382 | 2674772 | UBA7 | GACTCTACAGTCTTGATGCCCTAAG |
| 383 | 2674773 | UBA7 | TGTTTCGGGACCTTCAGACCTCACA |
| 384 | 2674773 | UBA7 | GGGACTTCGGAGACTACAAACTCTT |
| 385 | 2674773 | UBA7 | GTCGTCTTCCTTGACTTGTTTCGGG |
| 386 | 2674773 | UBA7 | CCTCACACCCGGGAGGGACTTCGG |
| 387 | 2674775 | UBA7 | AGGAGATGCATGACCGTCGACGGTT |
| 388 | 2674775 | UBA7 | TAGATCTCGACCGAAGCCGAAGACG |
| 389 | 2674775 | UBA7 | GTCCTGACCTGACGTGAGTCCCTCG |
| 390 | 2674775 | UBA7 | CGGTTGGACATACGGGTCTACGTAC |
| 391 | 2674776 | UBA7 | GGGAGTCTCGTCTCCATCCGTAAAG |
| 392 | 2674776 | UBA7 | GGTCTCTCTCGGTACGAACACGTAT |
| 393 | 2674776 | UBA7 | ACCCTAAGACATCCCTCGAGGTTCT |
| 394 | 2674776 | UBA7 | CGTTTCCGTCCGTGAGTTTGTCTAG |
| 395 | 2674777 | UBA7 | CACGAACTCCTACCTTGAGGGAAGA |
| 396 | 2674777 | UBA7 | CAGTCCAGGGTTTGTCACAGGGGTC |
| 397 | 2674777 | UBA7 | GGGAAGACCAGTCCAGGGTTTGTCA |
| 398 | 2674777 | UBA7 | CGAACTCCTACCTTGAGGGAAGACC |
| 399 | 2674778 | UBA7 | TCGGGTCGTCGAAGATGAATGGATG |
| 400 | 2674778 | UBA7 | CGGGTCGTCGAAGATGAATGGATGG |
| 401 | 2674778 | UBA7 | GTCGTCGAAGATGAATGGATGATC |
| 402 | 2674778 | UBA7 | CACACCGATCCCCAACCCTGCGACC |
| 403 | 2674779 | UBA7 | CGACTCCGTGAAGGGTGGATTATTT |
| 404 | 2674779 | UBA7 | TTTGAGACGAAAGTAATACCGTAGT |
| 405 | 2674779 | UBA7 | TACCGTAGTTTGTCGACGACTCCGT |
| 406 | 2674779 | UBA7 | ACGACTCCGTGAAGGGTGGATTATT |
| 407 | 2674780 | UBA7 | CACACCGCACCCGAGAACCGGTGAC |
| 408 | 2674780 | UBA7 | ACACCGCACCCGAGAACCGGTGACC |
| 409 | 2674781 | UBA7 | AGGACTCTCACGCAGGTGTCTTGAC |
| 410 | 2674781 | UBA7 | CTCTCACGCAGGTGTCTTGACCGTT |
| 411 | 2674781 | UBA7 | GACTCTCACGCAGGTGTCTTGACCG |
| 412 | 2674781 | UBA7 | CCCAGGACTCTCACGCAGGTGTCTT |
| 413 | 2674782 | UBA7 | CGGTGTCTGTGAGTGGAATGACTTC |
| 414 | 2674782 | UBA7 | CCTACTCGGTGTCTGTGAGTGGAAT |
| 415 | 2674782 | UBA7 | TGTACCTACTCGGTGTCTGTGAGTG |
| 416 | 2674782 | UBA7 | ACTCGGTGTCTGTGAGTGGAATGAC |
| 417 | 2674784 | UBA7 | AAACTTCTTGAGAAGGCTGACAGAC |
| 418 | 2674784 | UBA7 | GAAGGCTGACAGACGTCTCTGGTAG |
| 419 | 2674784 | UBA7 | ACTTCTTGAGAAGGCTGACAGACGT |
| 420 | 2674784 | UBA7 | CTTGAGAAGGCTGACAGACGTCTCT |
| 421 | 2674785 | UBA7 | CCGCGATACACCGACGAGCAACGTG |
| 422 | 2674785 | UBA7 | AACGTGGGTGATAGACTTCGGTGAC |
| 423 | 2674785 | UBA7 | GGATGGGACAGACATGGCACGCCAT |
| 424 | 2674785 | UBA7 | ATGGCACGCCATGAAGGGATCGTGT |
| 425 | 2674786 | UBA7 | GAACTGAAGCCTCCAGTCAGGGAAC |
| 426 | 2674786 | UBA7 | ACTCACGAACTGAAGCCTCCAGTCA |
| 427 | 2674786 | UBA7 | AAGCCTCCAGTCAGGGAACGGGTGT |
| 428 | 2674786 | UBA7 | ACTGAAGCCTCCAGTCAGGGAACGG |
| 429 | 2674787 | UBA7 | GAGGGCACACCTACCACACCGACGA |
| 430 | 2674787 | UBA7 | TCTGAATGTCCACTAGGGCGAGTGG |
| 431 | 2674787 | UBA7 | GGTGTCTCGTGTAGATACCCCTATT |

TABLE 1-continued

PORTOS Target Sequences

| SEQ ID NO. | Affy Probeset ID | Gene | Sequence |
|---|---|---|---|
| 432 | 2674787 | UBA7 | CACTAGGGCGAGTGGATGGGTGACC |
| 433 | 2674789 | UBA7 | CACTCACGACTGGGGAGAGGTGTGA |
| 434 | 2674789 | UBA7 | ACTCACGACTGGGGAGAGGTGTGAG |
| 435 | 2674790 | UBA7 | TCGCGAGGTTAGAGTCGGCAGTCAA |
| 436 | 2674790 | UBA7 | ACGAGTTTCAGAAACGGGATCACCC |
| 437 | 2674790 | UBA7 | TACCTGGTGTATCTCGCGAGGTTAG |
| 438 | 2674790 | UBA7 | CTGACAACAACTGTACCTGGTGTAT |
| 439 | 2674791 | UBA7 | TCCGTCGGCGATACTACCCGTTTAA |
| 440 | 2674791 | UBA7 | AGTCCTCTTTGACTCTGCGGTCGTG |
| 441 | 2674791 | UBA7 | ACTACCCGTTTAACGTCACAAACCC |
| 442 | 2674791 | UBA7 | TTGACTCTGCGGTCGTGATGGAGGA |
| 443 | 2674792 | UBA7 | CGGGAGCTAACAGAAGGCCTTCTAC |
| 444 | 2674792 | UBA7 | ATGAAACTACGGGAGCTAACAGAAG |
| 445 | 2674792 | UBA7 | AACAGAAGGCCTTCTACCCCTCGAG |
| 446 | 2674792 | UBA7 | CAGAAGGCCTTCTACCCCTCGAGGA |
| 447 | 2674793 | UBA7 | TGGGTCGCGATCTCTCGTCGGGACC |
| 448 | 2674793 | UBA7 | GACCCACTTCGGAGGTCGGTCCTAG |
| 449 | 2674793 | UBA7 | CACAGTCTCCCGTGGGTCGCGATCT |
| 450 | 2674793 | UBA7 | GGACCTCGGAAGTGGTTGGACCCAC |
| 451 | 2674794 | UBA7 | GAACTCGGGATACCACCGGTACGAC |
| 452 | 2674794 | UBA7 | TCAGCGGGATTCGTCACGTCCACAG |
| 453 | 2674794 | UBA7 | GACCTTGGTGACTTCGCCTGTCTCC |
| 454 | 2674794 | UBA7 | TACTCCGGGATCACGCCTGTCAGCG |
| 455 | 2674795 | UBA7 | ATACGGGTGTCTCAGGATGGTTGTC |
| 456 | 2674795 | UBA7 | GTCCGACCCCGATGATACGGGTGTC |
| 457 | 2674795 | UBA7 | ACCCCGATGATACGGGTGTCTCAGG |
| 458 | 2674795 | UBA7 | CGACCCCGATGATACGGGTGTCTCA |
| 459 | 2674796 | UBA7 | ACGTAGTCCGGAAGACACGTGACGT |
| 460 | 2674796 | UBA7 | TAGTCCGGAAGACACGTGACGTGTT |
| 461 | 2674796 | UBA7 | GTAGTCCGGAAGACACGTGACGTGT |
| 462 | 2674796 | UBA7 | CGTGGAGGTACCGGCCGGTGGGGTC |
| 463 | 2674797 | UBA7 | AAAGAGAGCCATGAACGCACCACCC |
| 464 | 2674797 | UBA7 | TGTTGAAAGAGAGCCATGAACGCAC |
| 465 | 2674797 | UBA7 | CATGAACGCACCACCCCGATAGTGA |
| 466 | 2674797 | UBA7 | CTCTGTGTTGTTGAAAGAGAGCCAT |
| 467 | 2674798 | UBA7 | CCAACTCGAGTTGCTGACACTAGGG |
| 468 | 2674798 | UBA7 | GAACCACTGAAAGAGCCCTTAACTC |
| 469 | 2674798 | UBA7 | CCCGGTTATGGGTGATGAAGGCACT |
| 470 | 2674798 | UBA7 | TTAACTCCCTTACCAACTCGAGTTG |
| 471 | 2674799 | UBA7 | AAGACACTGAAACCACTCCTGAAGT |
| 472 | 2674799 | UBA7 | ACAAGACACTGAAACCACTCCTGAA |
| 473 | 2674799 | UBA7 | CAAGACACTGAAACCACTCCTGAAG |
| 474 | 2674801 | UBA7 | TCCACCCGTGGAACACAGTATTCGT |
| 475 | 2674801 | UBA7 | GACTTCCACCCGTGGAACACAGTAT |
| 476 | 2674801 | UBA7 | CCGTGGAACACAGTATTCGTACCTC |
| 477 | 2674801 | UBA7 | TCAAACGAAAGACCGCCGACTGTGG |
| 478 | 2674802 | UBA7 | ACGTGTGCCCACTGTAGTGACTCCT |
| 479 | 2674802 | UBA7 | GAGTTGTCTCGACAGGTCCAGCAGC |
| 480 | 2674802 | UBA7 | GAGAGTTCTCGAGAACCGAGTCGAG |
| 481 | 2674802 | UBA7 | ACTCCTGGACGACAACCTGAAGGTC |
| 482 | 2674804 | UBA7 | ACCCGTCGGAGTGAGACGTACTAGG |
| 483 | 2674804 | UBA7 | CGTCGGAGTGAGACGTACTAGGGGT |
| 484 | 2674804 | UBA7 | CCCGTCGGAGTGAGACGTACTAGGG |
| 485 | 2674804 | UBA7 | GGGTGGACGACCAGGCTGGACCGAC |
| 486 | 2674805 | UBA7 | TACCTACGGGACCTGCGAAGCTTCG |
| 487 | 2674805 | UBA7 | TGCGAAGCTTCGATGACCTACTCCT |
| 488 | 2674805 | UBA7 | ACCTGCGAAGCTTCGATGACCTACT |
| 489 | 2674805 | UBA7 | ACGGGACCTGCGAAGCTTCGATGAC |
| 490 | 2674806 | UBA7 | ATGACAGTGGCGGTGGATGTGTTTC |
| 491 | 2674806 | UBA7 | CGGTGGATGTGTTTCTGGGATAGAG |
| 492 | 2674806 | UBA7 | ACAGTGGCGGTGGATGTGTTTCTGG |
| 493 | 2674806 | UBA7 | GTGGCGGTGGATGTGTTTCTGGGAT |
| 494 | 2674807 | UBA7 | GACACTGGTCGTCGCAGGGAATAAG |
| 495 | 2674807 | UBA7 | CCAAGGACAAACGTGACCGATGTCG |
| 496 | 2674807 | UBA7 | TAAGCGAACCGGAACCAAGGACAAA |
| 497 | 2674807 | UBA7 | GTCGTCGCAGGGAATAAGCGAACCG |
| 498 | 2691669 | HCLS1 | CAGGAGAGATAGGACCTACTCGAGT |
| 499 | 2691669 | HCLS1 | GGGCCCTTTCATGCAGATCTAACAC |
| 500 | 2691669 | HCLS1 | GAAAGACAAGTCAGGATTTAAGCT |
| 501 | 2691669 | HCLS1 | ACCAAACGGAGTAACACGATAAACG |
| 502 | 2691670 | HCLS1 | CCCCGTCTCTGTCGTACCCCTTCCT |
| 503 | 2691670 | HCLS1 | CAAGACCTGTCTGAAGGGAGAGGAC |
| 504 | 2691670 | HCLS1 | AGTAATTCCCGAACCCCGTCTCTGT |
| 505 | 2691670 | HCLS1 | GGGAGAGGACGAAGTAATTCCCGAA |

TABLE 1-continued

PORTOS Target Sequences

| SEQ ID NO. | Affy Probeset ID | Gene | Sequence |
|---|---|---|---|
| 506 | 2691671 | HCLS1 | GGGATAAGGACGACGTTTACAGATT |
| 507 | 2691671 | HCLS1 | GACAGATGACGTTGACACTAAAGGG |
| 508 | 2691671 | HCLS1 | GGAGGGATAAGGACGACGTTTACAG |
| 509 | 2691671 | HCLS1 | AGGGATAAGGACGACGTTTACAGAT |
| 510 | 2691672 | HCLS1 | CTGCATTAGTGACTGTAACTCTACC |
| 511 | 2691672 | HCLS1 | AGGAAACTAGGCCTGCTGCATTAGT |
| 512 | 2691672 | HCLS1 | CTTCACTACTCGAAAGGAAACTAGG |
| 513 | 2691672 | HCLS1 | GGCCTGCTGCATTAGTGACTGTAAC |
| 514 | 2691674 | HCLS1 | TCGACACCGACATATACTAATGGTT |
| 515 | 2691674 | HCLS1 | AGTCGACACCGACATATACTAATGG |
| 516 | 2691674 | HCLS1 | GTCGACACCGACATATACTAATGGT |
| 517 | 2691674 | HCLS1 | GACACCGACATATACTAATGGTTCC |
| 518 | 2691675 | HCLS1 | CCTCCACGAGCTCGGACTTCTAAGA |
| 519 | 2691675 | HCLS1 | CCACGAGCTCGGACTTCTAAGAAGA |
| 520 | 2691675 | HCLS1 | CTGATACTCCTCCACGAGCTCGGAC |
| 521 | 2691675 | HCLS1 | CCCTGATACTCCTCCACGAGCTCGG |
| 522 | 2691676 | HCLS1 | CAACTCCTCTACCTGTCCGTACTCG |
| 523 | 2691676 | HCLS1 | TCCTCTACCTGTCCGTACTCGTCCT |
| 524 | 2691676 | HCLS1 | TGCAACTCCTCTACCTGTCCGTACT |
| 525 | 2691676 | HCLS1 | ACTCCTCTACCTGTCCGTACTCGTC |
| 526 | 2691677 | HCLS1 | CTCGGGCTCGGACTCTTACTGATAC |
| 527 | 2691677 | HCLS1 | CGGGCTCGGACTCTTACTGATACTC |
| 528 | 2691677 | HCLS1 | CATGCTTCGTCTCGGACTCGGACTC |
| 529 | 2691677 | HCLS1 | TGCTTCGTCTCGGACTCGGACTCGG |
| 530 | 2691678 | HCLS1 | TCGAGACGGGGATCCTGAGACCTT |
| 531 | 2691679 | HCLS1 | GGAGGTAGTAGTCTCAGACTCGGAC |
| 532 | 2691679 | HCLS1 | TGGGTCACGGGAACGACGGGTAATC |
| 533 | 2691679 | HCLS1 | ACGGGTAATCCGTCTGAGAGGGCCT |
| 534 | 2691679 | HCLS1 | ACCGGAGGTCAACCCTGAGGAGGTA |
| 535 | 2691680 | HCLS1 | TGACGGGTTCTTTTAGAGGAGTCTC |
| 536 | 2691680 | HCLS1 | GGTCACTATCGATACCTTCTCGGTC |
| 537 | 2691680 | HCLS1 | TCACTATCGATACCTTCTCGGTCGT |
| 538 | 2691680 | HCLS1 | CTCGGTCGTCATGGCCGGGGTGACG |
| 539 | 2691684 | HCLS1 | AAACCACCGGTCATACCTTAGGTCT |
| 540 | 2691684 | HCLS1 | AACCACCGGTCATACCTTAGGTCTT |
| 541 | 2691684 | HCLS1 | CCGAAACCACCGGTCATACCTTAGG |
| 542 | 2691684 | HCLS1 | CGAAACCACCGGTCATACCTTAGGT |
| 543 | 2691686 | HCLS1 | ACCTCTTCCTATTTACCCTGTTTCG |
| 544 | 2691686 | HCLS1 | CTCTCTGCCTCTTTGTGCTCAGGGT |
| 545 | 2691686 | HCLS1 | TTCGTCGAGACCCTATACTGATGTT |
| 546 | 2691686 | HCLS1 | GATGTTCCCTCTCTGCCTCTTTGTG |
| 547 | 2691692 | HCLS1 | GTCGTCAGCCGAAACTAATATTTCC |
| 548 | 2691692 | HCLS1 | TCGTCAGCCGAAACTAATATTTCCT |
| 549 | 2691692 | HCLS1 | GTCAGCCGAAACTAATATTTCCTCT |
| 550 | 2691692 | HCLS1 | AGTCGTCAGCCGAAACTAATATTTC |
| 551 | 2691693 | HCLS1 | ACGAGACATCATAGGACACAGGTAT |
| 552 | 2691693 | HCLS1 | TGGGTCAGTCACACAGTACATTTAG |
| 553 | 2691693 | HCLS1 | CGGACGGAAACGAATTAGTGGCTAA |
| 554 | 2691693 | HCLS1 | CGAGGTTTTGAGACGCCATTACAAC |
| 555 | 2691694 | HCLS1 | AATTAATCCACCTGTACGTAGGAAT |
| 556 | 2691694 | HCLS1 | AACAATTAATCCACCTGTACGTAGG |
| 557 | 2691694 | HCLS1 | ACAATTAATCCACCTGTACGTAGGA |
| 558 | 2691694 | HCLS1 | TTAATCCACCTGTACGTAGGAATTT |
| 559 | 2691695 | HCLS1 | TGTCGAGGAAGTGTCAATCGACTCT |
| 560 | 2691695 | HCLS1 | GTCGAGGAAGTGTCAATCGACTCTA |
| 561 | 2691695 | HCLS1 | CTCCTGTCGAGGAAGTGTCAATCGA |
| 562 | 2691695 | HCLS1 | CCTGTCGAGGAAGTGTCAATCGACT |
| 563 | 2691696 | HCLS1 | CTTAGTAGATTCGAGAAGAAACCG |
| 564 | 2691696 | HCLS1 | ATGAGTACGGCAAATCCTTTTGTCT |
| 565 | 2691696 | HCLS1 | AATCGTAGTTAGATACTTCAGGTCT |
| 566 | 2691696 | HCLS1 | TATTAAGGAGTTCGGTGACCAAAAA |
| 567 | 2691697 | HCLS1 | CGACACTCCTGGACTGTGGCAGTGT |
| 568 | 2691697 | HCLS1 | GGAACCACGGTTACAACCTTCGGTG |
| 569 | 2691697 | HCLS1 | TACCTCCGTGTACGAAGAAACAACT |
| 570 | 2691697 | HCLS1 | CCTTCGGTGTACGACTCGACTTTCT |
| 571 | 2691698 | HCLS1 | CTGGTGAGAGAGGGTTGGTGGGT |
| 572 | 2691698 | HCLS1 | CATTCACTGGTGAGAGAGAGGGTTG |
| 573 | 2691698 | HCLS1 | CACTGGTGAGAGAGGGTTGGTGG |
| 574 | 2691698 | HCLS1 | TTCACTGGTGAGAGAGAGGGTTGGT |
| 575 | 2691699 | HCLS1 | GTACTCATACAACGGCTCCACCTCT |
| 576 | 2691699 | HCLS1 | CGAAACCCCGTTCATGCCTCAACT |
| 577 | 2691699 | HCLS1 | CGTGAGAAGAGTCTGCCTACGACGG |
| 578 | 2691699 | HCLS1 | ATGCCTCAACTCTCCCTGTCCCGTC |
| 579 | 2691700 | HCLS1 | GATACCTCCAGCCAAACCTCATCTT |

TABLE 1-continued

PORTOS Target Sequences

| SEQ ID NO. | Affy Probeset ID | Gene | Sequence |
|---|---|---|---|
| 580 | 2691700 | HCLS1 | CTCAGTCCCGGGTTTCGTAGGGTAC |
| 581 | 2691700 | HCLS1 | CTCATCTTTCTCTGGCTTACCTGTT |
| 582 | 2691700 | HCLS1 | ACTCCTTGTTTCATAGTCTCCTCGT |
| 583 | 2691701 | HCLS1 | TACTCGGAACCAGTACACCAAAGAA |
| 584 | 2691701 | HCLS1 | CGGAACCAGTACACCAAAGAAGGTC |
| 585 | 2691701 | HCLS1 | CTCGGAACCAGTACACCAAAGAAGG |
| 586 | 2691701 | HCLS1 | TCGGAACCAGTACACCAAAGAAGGT |
| 587 | 2691708 | HCLS1 | GTTGACCTACTGTTATGGTGTAACA |
| 588 | 2691708 | HCLS1 | CACCTACTGGTGTAACGTGTTCGTT |
| 589 | 2691708 | HCLS1 | AAAATTTTTCACAGTCACCTACTGG |
| 590 | 2691708 | HCLS1 | TCGTTGTATGACACTTTCGGACCGT |
| 591 | 2691709 | HCLS1 | CACCCAGATAACCTAATTGACGGAG |
| 592 | 2691709 | HCLS1 | ATGGACACACAGTAACGTATAAAGG |
| 593 | 2691709 | HCLS1 | GGAAATCATTCCGTACTCTCTAAGT |
| 594 | 2691709 | HCLS1 | AGATCTCAGACAAGGACACACATGG |
| 595 | 2691710 | HCLS1 | TCGGGTTTCTTTTGAGCCTCTGAAC |
| 596 | 2691710 | HCLS1 | TCTCGGGTTTCTTTTGAGCCTCTGA |
| 597 | 2691711 | HCLS1 | TAGCTCCCCAGACCTGCGTGTCTTG |
| 598 | 2691711 | HCLS1 | TCGGTTCTGGTAGCTCCCCAGACCT |
| 599 | 2691711 | HCLS1 | CTGGTAGCTCCCCAGACCTGCGTGT |
| 600 | 2691711 | HCLS1 | GTTCTGGTAGCTCCCCAGACCTGCG |
| 601 | 2691714 | HCLS1 | CTGTCCGGTACCGTCCGATGTGACT |
| 602 | 2691714 | HCLS1 | CCCCGTACGTGCTATGGACCATAGT |
| 603 | 2691714 | HCLS1 | GTAGACCCGGTGAGACACTAGAAAC |
| 604 | 2691714 | HCLS1 | TGTCGGAGTATGACCCTGATTAAC |
| 605 | 2691715 | HCLS1 | GGTACTACACAGACAAAGGCACCTC |
| 606 | 2691715 | HCLS1 | GGGTCCCACTACTAACCCTGTGTCT |
| 607 | 2691715 | HCLS1 | AGACATCACCCGGTACTACACAGAC |
| 608 | 2691715 | HCLS1 | AACCCTGTGTCTAGGACTGAAACAC |
| 609 | 2691717 | HCLS1 | TCGGCCCGCGAATCTTGTCTCCGAA |
| 610 | 2691717 | HCLS1 | CGAATCTTGTCTCCGAACGTGTCCA |
| 611 | 2691717 | HCLS1 | CGTCGTCGAGTCAAAGAGTGAGGCT |
| 612 | 2691717 | HCLS1 | GTCAAAGAGTGAGGCTTCACCGTCG |
| 613 | 2706793 | ZMAT3 | CCCCGACGTCTTACTGTTTGCACAG |
| 614 | 2706793 | ZMAT3 | TGCGTAAAACACAAGGTCAAATTAT |
| 615 | 2706793 | ZMAT3 | GACGAAAACAACTACCGAGTAAAAC |
| 616 | 2706793 | ZMAT3 | AGCCTCACGGTCAGTGACGAAACCT |
| 617 | 2706794 | ZMAT3 | ATCTTTGCGGGACGATCTGACTAAA |
| 618 | 2706794 | ZMAT3 | GACCTCATACAGTCTAGGACGAAAT |
| 619 | 2706794 | ZMAT3 | TTCGGGCTGCGTCAACGATTTTTAG |
| 620 | 2706794 | ZMAT3 | ACAAGTGGACACCATAGGAACTGAC |
| 621 | 2706795 | ZMAT3 | GATTTGACTCACACGGGACATTAGG |
| 622 | 2706795 | ZMAT3 | GGGTCACGGGAATTACCTACAATAC |
| 623 | 2706795 | ZMAT3 | GGGATGGTAACACTCGTCAATGACA |
| 624 | 2706795 | ZMAT3 | ACGACCGGCGAACCAAGATACTAAT |
| 625 | 2706796 | ZMAT3 | ACTATCTAGTGAAACCGTAGACTAT |
| 626 | 2706796 | ZMAT3 | AACATTAAGCCGAAAGAACTTCTAT |
| 627 | 2706796 | ZMAT3 | TCAAAGTGATAGAAGCAAAGGTCAT |
| 628 | 2706796 | ZMAT3 | TAGACTAAGAATGCCAAATGAATGT |
| 629 | 2706797 | ZMAT3 | GGGTGTCACCATGGTACTCTACAGT |
| 630 | 2706797 | ZMAT3 | CGGACTGCCGAATCTTGAAACTGAT |
| 631 | 2706797 | ZMAT3 | ACAGTTGAACGGGACGAAACACCAG |
| 632 | 2706797 | ZMAT3 | CCAGTTACCACAACTCGGCGAGTAT |
| 633 | 2706798 | ZMAT3 | CACAATGAGGTTCACCGGTCAAAAT |
| 634 | 2706798 | ZMAT3 | AGACTTGTCGCCATGTCCTTACTCT |
| 635 | 2706798 | ZMAT3 | CGTTCGTTGTATTCTCGTTCCACAG |
| 636 | 2706798 | ZMAT3 | AATGACGAGTTACACATTACAACCT |
| 637 | 2706799 | ZMAT3 | AGGAATGAAGTTAGGGGCGAGAGCC |
| 638 | 2706799 | ZMAT3 | AATGAAGTTAGGGGCGAGAGCCGTC |
| 639 | 2706799 | ZMAT3 | CAGGAATGAAGTTAGGGGCGAGAGC |
| 640 | 2706799 | ZMAT3 | GGAATGAAGTTAGGGGCGAGAGCCG |
| 641 | 2706801 | ZMAT3 | ACTACGGATTGTCCTCTTTATACAT |
| 642 | 2706801 | ZMAT3 | CAAATTCTACTACGGATTGTCCTCT |
| 643 | 2706801 | ZMAT3 | AGTCTCGACCCAGTTGCCGCCCGGT |
| 644 | 2706801 | ZMAT3 | TTCTACTACGGATTGTCCTCTTTAT |
| 645 | 2706802 | ZMAT3 | GTTCCCTTCTTAGTACGGTTCTCCG |
| 646 | 2706802 | ZMAT3 | ACACCGAGTCCGAGTGATAGTTCCC |
| 647 | 2706802 | ZMAT3 | CCGAGTGATAGTTCCCTTCTTAGTA |
| 648 | 2706802 | ZMAT3 | TTCTTAGTACGGTTCTCCGACGCCG |
| 649 | 2706803 | ZMAT3 | GGCTCACTAGGACCGGTGCCTCTTA |
| 650 | 2706803 | ZMAT3 | TAGGACCGGTGCCTCTTACTAATGA |
| 651 | 2706803 | ZMAT3 | GAAATTCGGTCCTCCGGCTCACTAG |
| 652 | 2706803 | ZMAT3 | CTCCGGCTCACTAGGACCGGTGCCT |
| 653 | 2706804 | ZMAT3 | CACCAGCTCGGACGTCGATGAGGTC |

TABLE 1-continued

PORTOS Target Sequences

| SEQ ID NO. | Affy Probeset ID | Gene | Sequence |
|---|---|---|---|
| 654 | 2706804 | ZMAT3 | TCGTTACACCAGCTCGGACGTCGAT |
| 655 | 2706804 | ZMAT3 | GTTACACCAGCTCGGACGTCGATGA |
| 656 | 2706804 | ZMAT3 | TACTCGTTACACCAGCTCGGACGTC |
| 657 | 2706805 | ZMAT3 | CATTCTTTGAGGCTTTAATGATACG |
| 658 | 2706805 | ZMAT3 | CTTTGAGGCTTTAATGATACGTCGT |
| 659 | 2706805 | ZMAT3 | AGGCTTTAATGATACGTCGTTTATC |
| 660 | 2706805 | ZMAT3 | TAGTACCATTCTTTGAGGCTTTAAT |
| 661 | 2706806 | ZMAT3 | CATGACGTTTGAGACGTTACAGTGG |
| 662 | 2706806 | ZMAT3 | GAGACGTTACAGTGGAACTTGAGAC |
| 663 | 2706806 | ZMAT3 | TTACAGTGGAACTTGAGACGTGTCG |
| 664 | 2706806 | ZMAT3 | CGTTTGAGACGTTACAGTGGAACTT |
| 665 | 2706807 | ZMAT3 | GAAAACCCGTCCTCCGAAGGAACGG |
| 666 | 2706807 | ZMAT3 | TACTAGGAGAACGTTGTGCGGCACG |
| 667 | 2706807 | ZMAT3 | AAGGAACGGAGAACGTCCCCTTCTT |
| 668 | 2706807 | ZMAT3 | CAGTCACCGGTGGTCCAGATGTCCT |
| 669 | 2706808 | ZMAT3 | AGAGTAGTGGGTGACCTAATACGGG |
| 670 | 2706808 | ZMAT3 | AGTAGTGGGTGACCTAATACGGGGT |
| 671 | 2706808 | ZMAT3 | AAGAGTAGTGGGTGACCTAATACGG |
| 672 | 2706808 | ZMAT3 | GTAGTGGGTGACCTAATACGGGGTC |
| 673 | 2706814 | ZMAT3 | GCACTACCGTAGGTATGGCCCAACT |
| 674 | 2706814 | ZMAT3 | TAGACACGCACGTCGACGGAACCGG |
| 675 | 2706814 | ZMAT3 | CCCCTAAGGTAGGAAGCACTACCGT |
| 676 | 2706814 | ZMAT3 | GTCCACCTAGTAGACACGCACGTCG |
| 677 | 2706815 | ZMAT3 | GGAGGTGCACTGTCCCGAACGCGAC |
| 678 | 2706815 | ZMAT3 | TCGCCAAGGAAAGGCTACGAGAAAG |
| 679 | 2706815 | ZMAT3 | GCACTGTCCCGAACGCGACGAAGAT |
| 680 | 2706815 | ZMAT3 | CCCTGATCGCCAAGGAAAGGCTACG |
| 681 | 2706816 | ZMAT3 | GCCGCGCCTCTGACGGCCGCGCAGG |
| 682 | 2706816 | ZMAT3 | GCGCCTCTGACGGCCGCGCAGGGCC |
| 683 | 2706817 | ZMAT3 | CCAGCCCAACCTGACTGAAAACTGT |
| 684 | 2706817 | ZMAT3 | CGCCGGCCGCCTCTTTCAACGAGGC |
| 685 | 2706817 | ZMAT3 | ACTGAAAACTGTCAGTCGGAAGCCG |
| 686 | 2706817 | ZMAT3 | AACTGTCAGTCGGAAGCCGACGCCT |
| 687 | 2706819 | ZMAT3 | GTGTACGCGTCACCGCTGCGGCTCG |
| 688 | 2706819 | ZMAT3 | GTTACAAACCTAGGGTTACTGACCT |
| 689 | 2706819 | ZMAT3 | AATTGGCGGTTGGTCGTCCGATTCC |
| 690 | 2706819 | ZMAT3 | CTACTTTCAACGTTTTCGAGACGGG |
| 691 | 2733718 | BIN2 | TTCATAGATATCTGTGTCTGTGAAC |
| 692 | 2753897 | CDKN2AIP | AACAAACCAGAAATCCGGACGCCTC |
| 693 | 2753897 | CDKN2AIP | CGCCTCCCCGCAATAGACCTCCCGG |
| 694 | 2753897 | CDKN2AIP | GAGACCCGCGACAACAAACCAGAAA |
| 695 | 2753897 | CDKN2AIP | CGGCGCCCACGTCCGGCGTCACTGT |
| 696 | 2753898 | CDKN2AIP | ACACAAGCGCCGGACGTCCGGGTTG |
| 697 | 2753899 | CDKN2AIP | GCTGCCGCTCTGACTGTTTGTGACC |
| 698 | 2753899 | CDKN2AIP | GTGGCGGCCCTAAAAAACGAAGCGT |
| 699 | 2753899 | CDKN2AIP | AAAAGGTACCGGACCCGCTTGGTGC |
| 700 | 2753899 | CDKN2AIP | GCGACGGAGGCGATCGTGCCTACTT |
| 701 | 2753903 | CDKN2AIP | TTTTATGAATCATACCGACTTCCGT |
| 702 | 2753903 | CDKN2AIP | AGTTTCACTGTCTACGAGGTTGGAT |
| 703 | 2753903 | CDKN2AIP | TGTTGTTCTCTACTTGACCAACGGT |
| 704 | 2753903 | CDKN2AIP | CTGTCTACGAGGTTGGATATGTTGT |
| 705 | 2753904 | CDKN2AIP | TTTTCTCCCTATAGCTCATCGTTAC |
| 706 | 2753904 | CDKN2AIP | CTTTTCTCCCTATAGCTCATCGTTA |
| 707 | 2753905 | CDKN2AIP | CCATCTTCTCGGTAGGTTTTTGCT |
| 708 | 2753905 | CDKN2AIP | CATCTTCTCGGTAGGTTTTTGCTC |
| 709 | 2753905 | CDKN2AIP | ATCTTCTCGGTAGGTTTTTGCTCA |
| 710 | 2753905 | CDKN2AIP | TCTTCTCGGTAGGTTTTTGCTCAA |
| 711 | 2753906 | CDKN2AIP | ACCTCTAGCTAGACAAAGGTCGGTT |
| 712 | 2753906 | CDKN2AIP | GGAGACGGTTCTGTCTTGCACGTAG |
| 713 | 2753906 | CDKN2AIP | GACCGTAGAGGTCAGTCTTATCGAG |
| 714 | 2753906 | CDKN2AIP | AAGTTGCACATATCCCAGCCGGTAG |
| 715 | 2753907 | CDKN2AIP | GGTTTGGATCAAGTCTCTGTCGAAG |
| 716 | 2753907 | CDKN2AIP | CCGTGTAGGAATGACTGAGGGTTCT |
| 717 | 2753907 | CDKN2AIP | CGTCTTCGAGGTCTATTTGTGCCAA |
| 718 | 2753907 | CDKN2AIP | CGAGTCTCTAGCTCCACGGGAACAA |
| 719 | 2753908 | CDKN2AIP | TGAAGGAATCGTTCACACAGGGTCA |
| 720 | 2753908 | CDKN2AIP | GTCAACCGAAGATTCTCATCAAGAG |
| 721 | 2753908 | CDKN2AIP | GAGGGTCTGGTCACCTAGAGACCAA |
| 722 | 2753908 | CDKN2AIP | CAAGAGTCTGATCGTGGAGTGTCAA |
| 723 | 2753909 | CDKN2AIP | GGAACTACTTCTTAGCTCCGGACAT |
| 724 | 2753909 | CDKN2AIP | GTTCAGACACATAAACCCGTGACCG |
| 725 | 2753909 | CDKN2AIP | GTACCTCTCGAGGATTTACGTCGAT |
| 726 | 2753909 | CDKN2AIP | CCACCGAAATCAGGGTTACACTTAG |
| 727 | 2753910 | CDKN2AIP | CCATACGTAATCGTCGTATAATCAT |

TABLE 1-continued

PORTOS Target Sequences

| SEQ ID NO. | Affy Probeset ID | Gene | Sequence |
|---|---|---|---|
| 728 | 2753910 | CDKN2AIP | ACACATCAAGCCATCTCAGGATTTT |
| 729 | 2753910 | CDKN2AIP | GATCAAGAGAAGTGTGTCATCGTCA |
| 730 | 2753910 | CDKN2AIP | CATAATTCAACAGATGGTACAAAAG |
| 731 | 2753911 | CDKN2AIP | AGTGGTACTGAAACTGGCGACTTCT |
| 732 | 2753911 | CDKN2AIP | GTGTCATAAACTTACAAACTTTCAG |
| 733 | 2753911 | CDKN2AIP | ACAACGGGCATTACAACTTGCACAG |
| 734 | 2753911 | CDKN2AIP | ACACTGATGATAATTGTCTAACTAA |
| 735 | 2793222 | NEK1 | AGATTATAGGCTTTGATTTATGAAC |
| 736 | 2793222 | NEK1 | ATAAAGATTATAGGCTTTGATTTAT |
| 737 | 2793222 | NEK1 | TATAGGCTTTGATTTATGAACTAAA |
| 738 | 2793222 | NEK1 | GATTATAGGCTTTGATTTATGAACT |
| 739 | 2793223 | NEK1 | CCTGGTCTTGGTCCTTATGATATAG |
| 740 | 2793223 | NEK1 | TCGTCCGACCAACCGTATTATACAT |
| 741 | 2793223 | NEK1 | CCCGAGACAAATGTAGATATGTAAA |
| 742 | 2793223 | NEK1 | CCACAGATGTCAGGTCTACAAGAAG |
| 743 | 2793227 | NEK1 | AATCAGTACCGTCTACCTCGGATGG |
| 744 | 2793227 | NEK1 | TACCGTCTACCTCGGATGGTTCTTC |
| 745 | 2793227 | NEK1 | AAGAAGTAAATCAGTACCGTCTACC |
| 746 | 2793227 | NEK1 | GTCGTAGAAATACGGTTCTAAGAAG |
| 747 | 2793228 | NEK1 | CTTACGCTATCACAGAAATTGGTAA |
| 748 | 2793228 | NEK1 | CTTTTTAAGAAACTCCAAATACTCT |
| 749 | 2793228 | NEK1 | CACTTACACTTACGCTATCACAGAA |
| 750 | 2793228 | NEK1 | AATTGGTAAATCTCCTTGACTCTGA |
| 751 | 2793229 | NEK1 | ACGTCCGGAGCTACCTTGTCAATGA |
| 752 | 2793229 | NEK1 | ATGAATCCCTTGTTGGACCACTTCT |
| 753 | 2793229 | NEK1 | ACTTTCACGGGACTTGCTTCTTACC |
| 754 | 2793229 | NEK1 | TGTGTCTAAATGTTCTCGACGTCCG |
| 755 | 2793230 | NEK1 | CTCTACAAGCAGTTCTGTTAGAACT |
| 756 | 2793231 | NEK1 | GACAAGTCTTGGGAATACCTACAAG |
| 757 | 2793231 | NEK1 | TGGGAATACCTACAAGGGTGGCATC |
| 758 | 2793231 | NEK1 | GAGAGTTTCGACAAGTCTTGGGAAT |
| 759 | 2793231 | NEK1 | TCTTGGGAATACCTACAAGGGTGGC |
| 760 | 2793236 | NEK1 | CCTTGGTTACTAAGAGTCGTGAGAT |
| 761 | 2793236 | NEK1 | GTCAAGTCACAAGTGGTCTTCTTAG |
| 762 | 2793236 | NEK1 | GGAACGACTAACCTGAAAGTTGACC |
| 763 | 2793236 | NEK1 | ACGTAAAGCTAGAGTGAGCGTAAAT |
| 764 | 2793238 | NEK1 | GTTCTCGGTTCACCTTGTTTGTTTC |
| 765 | 2793238 | NEK1 | CTACTCTCGAACGGTACGTGATAAT |
| 766 | 2793238 | NEK1 | CTCTCGAACGGTACGTGATAATGAC |
| 767 | 2793238 | NEK1 | ACTCTCGAACGGTACGTGATAATGA |
| 768 | 2793239 | NEK1 | CAACTAAGAGGACAACTCTGTTTTT |
| 769 | 2793239 | NEK1 | ATTTGGGTAGTCGATAACAACTAAG |
| 770 | 2793239 | NEK1 | ACAACTCTGTTTTTCAGGGCTCAAG |
| 771 | 2793239 | NEK1 | GGGCTCAAGTCACTCCGTAGAGGTG |
| 772 | 2793240 | NEK1 | GCTGTCTAAGACAAGATTTCTATGA |
| 773 | 2793240 | NEK1 | TTAATCCAGGATTACCTAGAGGTTC |
| 774 | 2793240 | NEK1 | CCCTTTTCAGGCTGTCTAAGACAAG |
| 775 | 2793240 | NEK1 | CCTCTTCGACTTGATGTTGAAGTCT |
| 776 | 2793241 | NEK1 | GGAGACCTACTCAATTGTGATCTAT |
| 777 | 2793241 | NEK1 | ATCTATGTAGGAAGAGATGTTGACT |
| 778 | 2793241 | NEK1 | ACTCAATTGTGATCTATGTAGGAAG |
| 779 | 2793241 | NEK1 | CAGTTGAACACTAAGGAGACCTACT |
| 780 | 2793242 | NEK1 | CTTTATGAAGCATCTAATTTACTTT |
| 781 | 2793242 | NEK1 | TAGACTAGCGTTCTTCACCCTCCGT |
| 782 | 2793242 | NEK1 | TCGCTCTTTATGAAGCATCTAATTT |
| 783 | 2793242 | NEK1 | TTTAGTCAAAGTAGACTAGCGTTCT |
| 784 | 2793243 | NEK1 | ACTATGGGCCCTTTGAAGTCTTCTC |
| 785 | 2793243 | NEK1 | TGACTATGGGCCCTTTGAAGTCTTC |
| 786 | 2793243 | NEK1 | GGGCCCTTTGAAGTCTTCTCTACGT |
| 787 | 2793243 | NEK1 | CCTTTGAAGTCTTCTCTACGTTTTC |
| 788 | 2793244 | NEK1 | TTCGTTGTCTACTCTAGACAATAAA |
| 789 | 2793244 | NEK1 | TCGTTGTCTACTCTAGACAATAAAG |
| 790 | 2793244 | NEK1 | GAGGTAGTTTCGTTGTCTACTCTAG |
| 791 | 2793244 | NEK1 | GGTAGTTTCGTTGTCTACTCTAGAC |
| 792 | 2793246 | NEK1 | CGACGACATGATTTCTTGTTGATC |
| 793 | 2793246 | NEK1 | GCACGACGACATGATTTTCTTGTTG |
| 794 | 2793246 | NEK1 | ACGTGCACGACGACATGATTTTCTT |
| 795 | 2793246 | NEK1 | TTACGTGCACGACGACATGATTTTC |
| 796 | 2793247 | NEK1 | CTCCGCGTTTTTTAGCTTAGTGAC |
| 797 | 2793247 | NEK1 | ACTGTACTCCGCGTTTTTTAGCTT |
| 798 | 2793247 | NEK1 | CGCGTTTTTTAGCTTAGTGACTTC |
| 799 | 2793247 | NEK1 | GTACTCCGCGTTTTTTAGCTTAGT |
| 800 | 2793249 | NEK1 | CGTCGATACATACCTCCGTCCGGGT |
| 801 | 2793249 | NEK1 | TGGACCGTCGATACATACCTCCGTC |

TABLE 1-continued

PORTOS Target Sequences

| SEQ ID NO. | Affy Probeset ID | Gene | Sequence |
|---|---|---|---|
| 802 | 2793249 | NEK1 | TACATACCTCCGTCCGGGTCGAGAA |
| 803 | 2793249 | NEK1 | ACGTTTTGGACCGTCGATACATACC |
| 804 | 2793255 | NEK1 | TACGGGTCGGTCTTACCTACATGAT |
| 805 | 2793255 | NEK1 | CCACGGAGGCATATAGAAGTATCAA |
| 806 | 2793255 | NEK1 | AATCTCGCTAAACCCCAAGTGTCGT |
| 807 | 2793255 | NEK1 | GTGACCGAAAAGAGTGAATGATTAT |
| 808 | 2793256 | NEK1 | TATCGAATCATGGATGTGAAACACC |
| 809 | 2793256 | NEK1 | AAGACTCCACGTTTAAACCGGGAAC |
| 810 | 2793256 | NEK1 | GAACCCATGTTATTAAAAGACTCCA |
| 811 | 2793256 | NEK1 | AACCGGGAACTAATGAGACTTTCGT |
| 812 | 2793258 | NEK1 | AATGGTACGGTAAAAACTGGTTTAC |
| 813 | 2793258 | NEK1 | CCCTGATATCGAGGTAGTAGAAAAA |
| 814 | 2793258 | NEK1 | GTAGAAAAGAAGAGCTCCTGTCAT |
| 815 | 2793258 | NEK1 | ATATACCAGCTCCAGAAGGTCTTTC |
| 816 | 2793261 | NEK1 | ACCTTTCTTATTTATCCCGGTCCCT |
| 817 | 2793261 | NEK1 | GTTCCTACCTCTTTACACGATTCAC |
| 818 | 2793261 | NEK1 | TATTTATCCCGGTCCCTTGTTCCTA |
| 819 | 2793261 | NEK1 | TACCTCTTTACACGATTCACGACCA |
| 820 | 2793264 | NEK1 | GTCTCTTCTCTCACTTATGACCTCT |
| 821 | 2793264 | NEK1 | CTCTTCTCTCACTTATGACCTCTTC |
| 822 | 2793264 | NEK1 | TCTCTTCTCTCACTTATGACCTCTT |
| 823 | 2793266 | NEK1 | ACTAGTACAATGTATGGTACACAAT |
| 824 | 2793266 | NEK1 | TCGGAATGTCCTCAGTATTTTTCAG |
| 825 | 2793266 | NEK1 | CCTTACAGGAGGAAGACACAAAATG |
| 826 | 2793266 | NEK1 | AAACTCGTTGGATTCGTCTCGGTAA |
| 827 | 2793267 | NEK1 | CCTTATGGAAATCGTATATTCTTTA |
| 828 | 2793267 | NEK1 | CGGACGGCGATTTATACCTTATGGA |
| 829 | 2793267 | NEK1 | ATACCTTATGGAAATCGTATATTCT |
| 830 | 2793267 | NEK1 | TTTCGGACGGCGATTTATACCTTAT |
| 831 | 2793268 | NEK1 | CGAAGTCCTGTTTTGAGCTAAAGAC |
| 832 | 2793268 | NEK1 | GAGCTAAAGACAATACGGACGAGTC |
| 833 | 2793268 | NEK1 | CCTGTTTTGAGCTAAAGACAATACG |
| 834 | 2793268 | NEK1 | TGGTCGAAGTCCTGTTTTGAGCTAA |
| 835 | 2793269 | NEK1 | AAGCTTCAAACCTAGTGTCGGATAT |
| 836 | 2793269 | NEK1 | AAAAGCTTCAAACCTAGTGTCGGAT |
| 837 | 2793269 | NEK1 | TGTAAAAGCTTCAAACCTAGTGTCG |
| 838 | 2793269 | NEK1 | TTCAAACCTAGTGTCGGATATGGTC |
| 839 | 2793277 | NEK1 | TTGGACCATGACTTCTATTATAGAC |
| 840 | 2793277 | NEK1 | GACACAGAAACGTAATAAGGATACT |
| 841 | 2793277 | NEK1 | AAGGATACTAGAGGCGTCAAACCAC |
| 842 | 2793277 | NEK1 | GATCCCTATCTGGTAGTCAGTTGAG |
| 843 | 2793278 | NEK1 | ACTCGACACATGTGAATTTGTACGA |
| 844 | 2793278 | NEK1 | TACTCGACACATGTGAATTTGTACG |
| 845 | 2793281 | NEK1 | AACCTTAACGATCTCAAGAATTATC |
| 846 | 2793281 | NEK1 | CCTCTAAAACCTTAACGATCTCAAG |
| 847 | 2793281 | NEK1 | GATTTCTACCTTGTCATGTTGAACC |
| 848 | 2793281 | NEK1 | CTACCTTGTCATGTTGAACCTCTAA |
| 849 | 2793282 | NEK1 | CCGGGACTTTGTACATGTACTATCT |
| 850 | 2793282 | NEK1 | AGAAGTAGCTCTGTAATTTAGAGTC |
| 851 | 2793282 | NEK1 | AAAACCTGACCAAACATGTCTATAC |
| 852 | 2793282 | NEK1 | CTTTTTAAGAAGTAGCTCTGTAATT |
| 853 | 2793284 | NEK1 | CCTCCCCTAGACAAATTCGCTTATT |
| 854 | 2793284 | NEK1 | GTATCATTACCTAATGACACTCCCT |
| 855 | 2793284 | NEK1 | GTCTTTCCGCAAACAAAGTTCTCC |
| 856 | 2793284 | NEK1 | TTTACCGAGAGAGATGTATCATTAC |
| 857 | 2793287 | NEK1 | CTCTTCAACGTCATAACCGTTTGTA |
| 858 | 2793287 | NEK1 | CTCTCTTCAACGTCATAACCGTTTG |
| 859 | 2793287 | NEK1 | TCTCTTCAACGTCATAACCGTTTGT |
| 860 | 2793287 | NEK1 | TCTTCAACGTCATAACCGTTTGTAC |
| 861 | 2793288 | NEK1 | ACCTCTTCATACAATCTGATGTCTT |
| 862 | 2793288 | NEK1 | AGATGTCTTCTACCGTCTGTCATAC |
| 863 | 2793288 | NEK1 | CCGTCTGTCATACAATAGTTCCTTT |
| 864 | 2793288 | NEK1 | TTCGGTAAGAACAATTTAGATGTCT |
| 865 | 2793289 | NEK1 | GTATAGACATTTCTACGGAATCTTT |
| 866 | 2793289 | NEK1 | GATCGTATAGACATTTCTACGGAAT |
| 867 | 2793289 | NEK1 | ATTTACAGATCGTATAGACATTTCT |
| 868 | 2793289 | NEK1 | ACAGATCGTATAGACATTTCTACGG |
| 869 | 2793293 | NEK1 | GGATGATTGCAGGACACAGTGACTC |
| 870 | 2793293 | NEK1 | CAGTAGTGGCAATAAGGATGATTGC |
| 871 | 2793293 | NEK1 | CGGTGTGGATCTGACTACGAATAAT |
| 872 | 2793293 | NEK1 | TTACGCCCTACCATGGAGACGAAAT |
| 873 | 2793294 | NEK1 | GACGACGACCAATCTGTCAGAACCA |
| 874 | 2793294 | NEK1 | CTCTCAGAGTCACGGGGAAAGTCA |
| 875 | 2793294 | NEK1 | ACGGGGAAAGTCAGACCTGACACT |

TABLE 1-continued

PORTOS Target Sequences

| SEQ ID NO. | Affy Probeset ID | Gene | Sequence |
|---|---|---|---|
| 876 | 2793294 | NEK1 | ACGACCAATCTGTCAGAACCAAAGA |
| 877 | 2793295 | NEK1 | AATCAGGCGTAAGCGAGGTCCCAAA |
| 878 | 2793295 | NEK1 | CGTGCACCGTCAGTTCATCGAAGGG |
| 879 | 2793295 | NEK1 | TCACAGCTGGACAGAATGCCCGCAG |
| 880 | 2793295 | NEK1 | CACCGGTGATCGTTGCTGGAGACAC |
| 881 | 2806469 | IL7R | GGATCTAGATTCGAAGAGACAGAAG |
| 882 | 2806469 | IL7R | GTAAGTAAAGTATGTGTGACCGAGT |
| 883 | 2806469 | IL7R | AAGTAAAGTATGTGTGACCGAGTGT |
| 884 | 2806469 | IL7R | GGGATCTAGATTCGAAGAGACAGAA |
| 885 | 2806470 | IL7R | AATGAAGTTCAGCAAAGACCTCTTT |
| 886 | 2806470 | IL7R | ATGAAGTTCAGCAAAGACCTCTTTC |
| 887 | 2806470 | IL7R | GATCCATGTTGAAAACCGTACCAAA |
| 888 | 2806470 | IL7R | TGAAGTTCAGCAAAGACCTCTTTCA |
| 889 | 2806471 | IL7R | GAGTAAGAGTACGATATCGGTCAAC |
| 890 | 2806471 | IL7R | TGAGTAAGAGTACGATATCGGTCAA |
| 891 | 2806472 | IL7R | AAAACTCCTGGGTCTACAGTTGTAG |
| 892 | 2806472 | IL7R | CTGGGTCTACAGTTGTAGTGGTTAG |
| 893 | 2806472 | IL7R | CTACAGTTGTAGTGGTTAGACCTTA |
| 894 | 2806472 | IL7R | TTGTAGTGGTTAGACCTTAAACTTT |
| 895 | 2806474 | IL7R | ACCTCTTTTCTCAGATTGGACGTTT |
| 896 | 2806474 | IL7R | CGTTATATACACACTTCCAACCTCT |
| 897 | 2806474 | IL7R | GACGTTTTTTTATCTGGATTGGTGA |
| 898 | 2806474 | IL7R | CTCTATATAAAGTAGCTCTGTTTCT |
| 899 | 2806477 | IL7R | ATTTTCAAAATTACGTGCTACATCG |
| 900 | 2806477 | IL7R | AACTGGACTCACAGCAGATAGCCCT |
| 901 | 2806477 | IL7R | TCACAGCAGATAGCCCTTCCTCGGT |
| 902 | 2806477 | IL7R | ATCGAATGGCGGTCCTTTTCCTACT |
| 903 | 2806479 | IL7R | TTAAATAGGTCGTGTTTCGACTGTG |
| 904 | 2806479 | IL7R | GTACACTTAAATAGGTCGTGTTTCG |
| 905 | 2806479 | IL7R | ACACTTAAATAGGTCGTGTTTCGAC |
| 906 | 2806479 | IL7R | ACTTAAATAGGTCGTGTTTCGACTG |
| 907 | 2806480 | IL7R | CATACTCTAATTTCAAGCTAGGTAG |
| 908 | 2806480 | IL7R | TCTTTCGAGGTTGGCCGTCGTTACA |
| 909 | 2806480 | IL7R | GAGGTTGGCCGTCGTTACATACTCT |
| 910 | 2806480 | IL7R | GCTAGGTAGGGACTAGTGATAAAAT |
| 911 | 2806485 | IL7R | GGGTCAGAGGGGCTAGTATTCTTCT |
| 912 | 2806485 | IL7R | ATTCGGATAGCATACCGGGTCAGAG |
| 913 | 2806485 | IL7R | CAGAGGGGCTAGTATTCTTCTGAGA |
| 914 | 2806485 | IL7R | CTAATTCGGATAGCATACCGGGTCA |
| 915 | 2806486 | IL7R | AACCCTGATGTTTGTCGTGCGACGG |
| 916 | 2806486 | IL7R | TTGGGTCAACGAGTCCCAGTCGGGT |
| 917 | 2806486 | IL7R | CCTTAGGACTGTAACTTGGGTCAAC |
| 918 | 2806486 | IL7R | GGACCTGACGGTCTAAGTATCCCAC |
| 919 | 2806487 | IL7R | GCAGTGATCATTGTCCCACACGGAT |
| 920 | 2806487 | IL7R | GGGACCTGTACCCATGCAAACTGCT |
| 921 | 2806487 | IL7R | ATGGCACTCGCTGTTTCTACTAAAT |
| 922 | 2806487 | IL7R | ATACCCGACAAGTCTCCACGTGTGG |
| 923 | 2858024 | PLK2 | ACTGGTAAAATTTGGCAACCGTTAT |
| 924 | 2858024 | PLK2 | ACAACTGGTAAAATTTGGCAACCGT |
| 925 | 2858025 | PLK2 | GTACACCACCATGCTTTTGTTAAGG |
| 926 | 2858025 | PLK2 | TGTCCGATTCCGTATGTCAAGAACT |
| 927 | 2858025 | PLK2 | GCATTGACACTTGATACCGGTATAT |
| 928 | 2858025 | PLK2 | CTGAAAAGCTTACCTGGGATACCCT |
| 929 | 2858026 | PLK2 | CGGGACTTGTACGAGAATGTTTCTA |
| 930 | 2858026 | PLK2 | AGTTACTCCTATCCTATAGATGTTG |
| 931 | 2858026 | PLK2 | TTTAGCTTACCTTATACGGGACTTG |
| 932 | 2858026 | PLK2 | ACTTCTTATGGAAGAGTGGATGTAG |
| 933 | 2858028 | PLK2 | ACGAGAAATTACTACCGTGGAAAGT |
| 934 | 2858028 | PLK2 | CGATTTTAGACTATTCCGGGATTAC |
| 935 | 2858028 | PLK2 | CACCTCTAGACGGATCACAATGACT |
| 936 | 2858028 | PLK2 | CACAATGACTATAAGCTTCTGGAGC |
| 937 | 2858029 | PLK2 | AAACATCCGTGATTGAGTGAGGGA |
| 938 | 2858029 | PLK2 | TTGAGTGAGAGGATTAGAGAAGGTC |
| 939 | 2858029 | PLK2 | TTATTATTATCTCACGTACGATGTT |
| 940 | 2858030 | PLK2 | TGTCAAGTGATAATGCGTCTCGAAC |
| 941 | 2858030 | PLK2 | AGTTCACTGCCACGACTTTATGAAA |
| 942 | 2858030 | PLK2 | AATGCGTCTCGAACCGGTTACGAGT |
| 943 | 2858030 | PLK2 | AGGACTCGTTAAATAATCAGTTCAC |
| 944 | 2858031 | PLK2 | AAAGTCACCCAGTGGTTTACCCAAC |
| 945 | 2858031 | PLK2 | TGGCAGCCACAGGAAAAGTTGTTAC |
| 946 | 2858031 | PLK2 | AACCCATGGTCGAGAGTCTGGTGTG |
| 947 | 2858031 | PLK2 | AAGTTGTTACCACGAGTGTACTCGG |
| 948 | 2858032 | PLK2 | GTACCCTTCACAACGTCTGTGTCAC |
| 949 | 2858032 | PLK2 | CTGTGTCACCGTTCCCAAGAAGCCC |

TABLE 1-continued

PORTOS Target Sequences

| SEQ ID NO. | Affy Probeset ID | Gene | Sequence |
|---|---|---|---|
| 950 | 2858032 | PLK2 | TCATGGTACCCTTCACAACGTCTGT |
| 951 | 2858032 | PLK2 | AACTTCTGTCATGGTACCCTTCACA |
| 952 | 2858034 | PLK2 | GTCTAACCCCTACGATAAGCCTACT |
| 953 | 2858034 | PLK2 | TCCAGACCTTGTGGGCGTCATCTTT |
| 954 | 2858034 | PLK2 | CCTACGATAAGCCTACTATCAGTCT |
| 955 | 2858034 | PLK2 | CCTTGTGGGCGTCATCTTTTGTTCG |
| 956 | 2858035 | PLK2 | TGACGCAATAGAAAATAGACCGAAC |
| 957 | 2858035 | PLK2 | ACGGAGTGAGAGTAGAATTAGACCT |
| 958 | 2858035 | PLK2 | CGAAAACTACTCGAAAGGGTCGTT |
| 959 | 2858035 | PLK2 | CGTACGTTCACTCAAATGACGCAAT |
| 960 | 2858036 | PLK2 | CTTTTTCTGAAGTTATTGAGTCGTT |
| 961 | 2858036 | PLK2 | CTTCTGTAGATGTTCGAATCCGTAC |
| 962 | 2858036 | PLK2 | TAGATGTTCGAATCCGTACTAAACT |
| 963 | 2858036 | PLK2 | TCTGAAGTTATTGAGTCGTTGGGTC |
| 964 | 2858037 | PLK2 | GTTTCGTTCTATATAACTGTGTGTA |
| 965 | 2858037 | PLK2 | TTTCGTTCTATATAACTGTGTGTAT |
| 966 | 2858038 | PLK2 | CGACAACAGTATGTCAAGGTCTAAA |
| 967 | 2858038 | PLK2 | CAAGGTCTAAAGGTGAATAGTTCGG |
| 968 | 2858038 | PLK2 | GAATAGTTCGGGTCGATTCTTAAAG |
| 969 | 2858038 | PLK2 | GAGGCCTGTCTGACAGAAGATCGAC |
| 970 | 2858040 | PLK2 | TCGTTCCATATGTTACGGCAGGAGT |
| 971 | 2858040 | PLK2 | GGTCTCCTAGCAGGGTCAAACCTAC |
| 972 | 2858040 | PLK2 | CCTACTGTAGTAAGCTGTACTGAAA |
| 973 | 2858040 | PLK2 | CGAGGACGGTTCGTGAATTAACGAT |
| 974 | 2858042 | PLK2 | TGCTATACACCATGGGGTTTAATAG |
| 975 | 2858042 | PLK2 | ACACTTAGTCTGTAAACCCGGGACC |
| 976 | 2858042 | PLK2 | AATAGAGAGAGGACTTCAGGAGTTG |
| 977 | 2858042 | PLK2 | TTCAGGAGTTGTTTGTTCCTGTACC |
| 978 | 2858044 | PLK2 | CCGTCGGTCCGATCTTGGGAACCTT |
| 979 | 2858044 | PLK2 | CTTGAAAAATAATTACTTCGGTAC |
| 980 | 2858044 | PLK2 | CCTGAAGCCAGACCGTCGGTCCGAT |
| 981 | 2858044 | PLK2 | TCCGATCTTGGGAACCTTGTGTCTT |
| 982 | 2858045 | PLK2 | TGCGGTTTTCGACTCAAAACACAAT |
| 983 | 2858045 | PLK2 | CATTCAGTAACTGCGGTTTTCGACT |
| 984 | 2858046 | PLK2 | GGTCTTCAAGCTATGATGGAGTCCG |
| 985 | 2858046 | PLK2 | ATGGAGTCCGTCTAACACAGACCTG |
| 986 | 2858046 | PLK2 | TTCAAGCTATGATGGAGTCCGTCTA |
| 987 | 2858046 | PLK2 | AACACAGACCTGACTTTATGGAAGT |
| 988 | 2858047 | PLK2 | CATTCACAGTTGAGGATAAACTCTT |
| 989 | 2858047 | PLK2 | TCTCATAAAATAGACCCTAAAATCG |
| 990 | 2858047 | PLK2 | GGGCTTAATTGTACCATAAGTTTCT |
| 991 | 2858047 | PLK2 | CTCTTGTAAACGAATGGGGCTTAAT |
| 992 | 2858048 | PLK2 | ACGTCAAAATGGTGATGAAGCTCCT |
| 993 | 2858048 | PLK2 | CTTTTGTAAATGTAAGAGAACCTTA |
| 994 | 2858048 | PLK2 | AAGAAGTAGTATTCGTACATCACGT |
| 995 | 2858048 | PLK2 | AGAGAACCTTATGCGTCATCTTCC |
| 996 | 2858049 | PLK2 | ACTGAGAACTCATTTCATAAAAGAA |
| 997 | 2858049 | PLK2 | CACGCATACTGAGAACTCATTTCAT |
| 998 | 2858049 | PLK2 | TTTACAGAAGACGTACACATTAGTG |
| 999 | 2858049 | PLK2 | GAAGACGTACACATTAGTGACCGAA |
| 1000 | 2858050 | PLK2 | CGTCTCATCGATTTGGAGTAGTTTC |
| 1001 | 2858050 | PLK2 | TGCGGCGTTTTTAATAAGGAGTGTC |
| 1002 | 2858050 | PLK2 | TATTGTTTCAGATGCGGCGTTTTTA |
| 1003 | 2858050 | PLK2 | AACGTTTTACAATGCTCTACTGTCT |
| 1004 | 2858051 | PLK2 | ATAGACGAGGGTCCCTTAAAAGGAC |
| 1005 | 2858051 | PLK2 | AAGTACTCCCTCGAAATTGCTTCAG |
| 1006 | 2858051 | PLK2 | CGGCAGGTAAAAACACGGTAGGAGT |
| 1007 | 2858051 | PLK2 | GAGTTAAGGCAGAGCCGAAACAAAG |
| 1008 | 2858052 | PLK2 | GGTGCTGACCCTTCGCGATGACGGC |
| 1009 | 2858052 | PLK2 | TGAGCTTCTTCTTCGCCGGCGGCGT |
| 1010 | 2858052 | PLK2 | TGGTAAGCGTGAGCCCCGGCCTCTA |
| 1011 | 2858052 | PLK2 | CCGGCCTCTAGAGCGCCTAATAGCA |
| 1012 | 2858053 | PLK2 | AGTGAGCGTGTTCACCTGGCCCCAC |
| 1013 | 2858053 | PLK2 | TCCGTTCCCACGCTCCTGGTGCCGG |
| 1014 | 2858053 | PLK2 | TGGTGCCGGCCGAGCCTGCACACTG |
| 1015 | 2858053 | PLK2 | GCTCGCGAGAGTGAGCGTGTTCACC |
| 1016 | 2997377 | ANLN | TTTAAACTTGCCGACGTCTCCGGCT |
| 1017 | 2997377 | ANLN | CTTTAAGTTTAAACTTGCCGACGTC |
| 1018 | 2997377 | ANLN | ACACCCTCTCAAGGGGCGGAGTCT |
| 1019 | 2997377 | ANLN | GGCTCAGGCAGTGACCTTCGGCTCT |
| 1020 | 2997378 | ANLN | TAGCAGAGCATCAGGCTGCGGACCC |
| 1021 | 2997378 | ANLN | TGTGTGACTCGACTCTGAGTGAAAA |
| 1022 | 2997378 | ANLN | CTTGGTGGCAAAGGTAGCAGAGCAT |
| 1023 | 2997378 | ANLN | GGACTTAAACTTGGTGGCAAAGGTA |

TABLE 1-continued

PORTOS Target Sequences

| SEQ ID NO. | Affy Probeset ID | Gene | Sequence |
|---|---|---|---|
| 1024 | 2997379 | ANLN | CCTCCTTCCGAAACTCAGACAGGAT |
| 1025 | 2997379 | ANLN | AGGATTTTCCGACAACGCTCTCCAG |
| 1026 | 2997379 | ANLN | TCCGACAACGCTCTCCAGAAAGTCG |
| 1027 | 2997379 | ANLN | ACTCAGACAGGATTTTCCGACAACG |
| 1028 | 2997380 | ANLN | AGGACCGCGTCGTTCTCACTCCGCG |
| 1029 | 2997380 | ANLN | GCCTTGCCCAGGACGACCTTCGTCG |
| 1030 | 2997380 | ANLN | CGGGCGTCCCCTCTACGATTACTTT |
| 1031 | 2997380 | ANLN | CACTAAACGCCTCAAGTGCGTCGGG |
| 1032 | 2997381 | ANLN | GCTTGGGCACGGTCCGCTCTCTTAG |
| 1033 | 2997381 | ANLN | TTGACGACCTCGCTTGGGCACGGTC |
| 1034 | 2997381 | ANLN | GACGACCTCGCTTGGGCACGGTCCG |
| 1035 | 2997381 | ANLN | CGGTCCGCTCTCTTAGAAGTCTCTT |
| 1036 | 2997382 | ANLN | GTCGTCGAGGTTCCAGATACTGAGT |
| 1037 | 2997382 | ANLN | CCAGATACTGAGTACGATTCGCTCG |
| 1038 | 2997382 | ANLN | GAGTACGATTCGCTCGATCTGTCGG |
| 1039 | 2997382 | ANLN | GATTCGCTCGATCTGTCGGTGAAAG |
| 1040 | 2997384 | ANLN | TCTTTAGAACATGTTTTGGTAGCGG |
| 1041 | 2997384 | ANLN | ACCTTTTATTTGTTGGTCAACTCAG |
| 1042 | 2997384 | ANLN | AACAAGAGGTTCAGGACACAGAGGA |
| 1043 | 2997384 | ANLN | AGCGGTAGTTTTTTTGCGACAAGAC |
| 1044 | 2997385 | ANLN | TTGAACGTCTCGTTGCCGCGGCAAC |
| 1045 | 2997385 | ANLN | CGGTGTTCGTCGTCTATGGTAGTCA |
| 1046 | 2997385 | ANLN | CACTAAGACAACGACAGGGCCGTAG |
| 1047 | 2997385 | ANLN | GCGGCAACCCTATTACTACTATACT |
| 1048 | 2997387 | ANLN | ACGACGTTGATAAACGAGGACCCTT |
| 1049 | 2997387 | ANLN | CGAAAGTTTACGGAGCCGTTGAGGT |
| 1050 | 2997387 | ANLN | TTACGGAGCCGTTGAGGTCAACCGT |
| 1051 | 2997387 | ANLN | GTCTTCCCCGGCAGACCGGTTAGAA |
| 1052 | 2997388 | ANLN | CGGGATAGGAGTTCACGACTACTAC |
| 1053 | 2997388 | ANLN | CTACCGCTACGGAGAAACTTATTTC |
| 1054 | 2997388 | ANLN | CGGACCATGGCGAACAAATAGGTTT |
| 1055 | 2997388 | ANLN | CACAATTCGTCCTTCGATGTAAGAC |
| 1056 | 2997389 | ANLN | AATAGGGTCTGTCAAGGTAGGTTCC |
| 1057 | 2997389 | ANLN | CCATAGCTTTGGTTAACACTTCAGT |
| 1058 | 2997389 | ANLN | TCAACACTCCCTGTTTTAGGACTCG |
| 1059 | 2997389 | ANLN | AGGTCACTTTAGATGATGTAGATAG |
| 1060 | 2997391 | ANLN | CGAAACCTCTCGCAACAGTTCTTGT |
| 1061 | 2997391 | ANLN | TCGGAAAGGACCTTGCGAAACCTCT |
| 1062 | 2997391 | ANLN | GTTTCTTTCAGGTCGAGCATCGTGT |
| 1063 | 2997391 | ANLN | GAGGTTTATGTTTCCGGTAGGTTCT |
| 1064 | 2997393 | ANLN | CCCGTTATATACCTCACGTCTTTTT |
| 1065 | 2997393 | ANLN | CGGCTAAACTGTTCCCGTTATATAC |
| 1066 | 2997393 | ANLN | TCTTGATCGTACAGAAGCACCGGCT |
| 1067 | 2997393 | ANLN | CACGTCTTTTTCCGCCTTTGAGTTT |
| 1068 | 2997394 | ANLN | TCCACTGGCTTTTGGTCTATGGTCG |
| 1069 | 2997394 | ANLN | AAAGTTTTTGAGTCAGTGAAGGTCA |
| 1070 | 2997394 | ANLN | TATGGTCGGTTTTAAGATCATGTC |
| 1071 | 2997394 | ANLN | CAAAGTTTTTGAGTCAGTGAAGGTC |
| 1072 | 2997395 | ANLN | GTAGTCTGGGTTTCCAACTCGTCTT |
| 1073 | 2997396 | ANLN | AGAAGTCACTACAGGATCTCCTTCC |
| 1074 | 2997396 | ANLN | CGTGACTTATAGAGGAGTTACAGAA |
| 1075 | 2997396 | ANLN | CCTAGTTCGTAATCGTCTTTCGTCG |
| 1076 | 2997396 | ANLN | AACGTGGTAACCGTGTTTGTCAACC |
| 1077 | 2997397 | ANLN | GTGGATCTGACCTTAACTTTCTGTG |
| 1078 | 2997397 | ANLN | CTGACCTTAACTTTCTGTGGTCGTC |
| 1079 | 2997397 | ANLN | TCAAATCACAGGTGTGGATCTGACC |
| 1080 | 2997397 | ANLN | AGGTGTGGATCTGACCTTAACTTTC |
| 1081 | 2997399 | ANLN | CTTTGTCTTGCAGGTAGTTATTTCG |
| 1082 | 2997399 | ANLN | TTGCAGGTAGTTATTTCGTCCACTA |
| 1083 | 2997399 | ANLN | ACTAACAAGCCTTCCTTCTACAATG |
| 1084 | 2997399 | ANLN | AAGTTTCTTTGTCTTGCAGGTAGTT |
| 1085 | 2997400 | ANLN | TCGTCTTTCTGAAGAAGATTAACGT |
| 1086 | 2997400 | ANLN | TGTCTGTCACTAGATAGTTCGATCG |
| 1087 | 2997400 | ANLN | CTTGAGTTATTGCTTTATTTATACG |
| 1088 | 2997400 | ANLN | TCGATCGGTCCGAGAATTGACGACA |
| 1089 | 2997402 | ANLN | ACGGTAGGTTTCCTAGTCAATGAAA |
| 1090 | 2997402 | ANLN | AGGCGAACGGAGATTTTCGTCTAAA |
| 1091 | 2997402 | ANLN | AATGAAACAGTCTTTAGGCGAACGG |
| 1092 | 2997402 | ANLN | GTCTAAAACAGACGTCATGCCAAGT |
| 1093 | 2997403 | ANLN | GAGAATTGCCACTACGAGACTGTAA |
| 1094 | 2997403 | ANLN | TACCATCGGTGTGGTAATCGTTCAT |
| 1095 | 2997403 | ANLN | GACTGTAAGTGATGATGTAAATGAG |
| 1096 | 2997403 | ANLN | AGTTTGAGAGAATTGCCACTACGAG |
| 1097 | 2997406 | ANLN | TTTCTAGGGAGTCCGGAACTATTCT |

TABLE 1-continued

PORTOS Target Sequences

| SEQ ID NO. | Affy Probeset ID | Gene | Sequence |
|---|---|---|---|
| 1098 | 2997406 | ANLN | TTCTTTCTAGGGAGTCCGGAACTAT |
| 1099 | 2997406 | ANLN | TCTAGGGAGTCCGGAACTATTCTTC |
| 1100 | 2997406 | ANLN | CTTTCTAGGGAGTCCGGAACTATTC |
| 1101 | 2997408 | ANLN | CACGACACGCTTGGTCGTTGAAGCG |
| 1102 | 2997408 | ANLN | CCGGTCAGGTCCTCCAGAATCACGA |
| 1103 | 2997408 | ANLN | AACCTAGAATGTGTAATAGTAACAG |
| 1104 | 2997408 | ANLN | CGTTGAAGCGGGAACAACCTAGAAT |
| 1105 | 2997409 | ANLN | CGCTCTCGATGACCCGATAAACAAG |
| 1106 | 2997409 | ANLN | ATTCTCTCGCTCTCGATGACCCGAT |
| 1107 | 2997409 | ANLN | TCGATGACCCGATAAACAAGGTCCT |
| 1108 | 2997409 | ANLN | ATGACCCGATAAACAAGGTCCTTTT |
| 1109 | 2997414 | ANLN | AGAATAACCTGAATAGGTCTACTAC |
| 1110 | 2997414 | ANLN | CAAAACCACGGACCGTAGCTTCTAC |
| 1111 | 2997414 | ANLN | GACCTTTGACATATAGAATAACCTG |
| 1112 | 2997414 | ANLN | CCGTAGCTTCTACCACACAAGAAAG |
| 1113 | 2997417 | ANLN | GACCCCGAGTAATATGACAACAAAC |
| 1114 | 2997417 | ANLN | AACCGACAACCGAGTACACACGGAT |
| 1115 | 2997417 | ANLN | ACCGTTCTCGATGGTCAACTATAAA |
| 1116 | 2997417 | ANLN | GCATAGTATCCTTAAGTACCGACGG |
| 1117 | 2997418 | ANLN | GTATCCTTCCTATTTAGACCGATTA |
| 1118 | 2997418 | ANLN | CCTTCCTATTTAGACCGATTAACAT |
| 1119 | 2997418 | ANLN | ATCCTTCCTATTTAGACCGATTAAC |
| 1120 | 2997418 | ANLN | CCTATTTAGACCGATTAACATGGTC |
| 1121 | 2997419 | ANLN | CACGTTCTGCGTTGTGAAAACTTAA |
| 1122 | 2997419 | ANLN | AGGCTGGTGTTTCTCTTCTACTGGC |
| 1123 | 2997419 | ANLN | TGGCTCTCTGAGAACAGTCGGTTAC |
| 1124 | 2997419 | ANLN | TCGGTTACGTCCCTGTGTGAGACAC |
| 1125 | 2997422 | ANLN | TTCTCGCCCTAGAGACCTACGTTTT |
| 1126 | 2997422 | ANLN | ACCTACGTTTTTGAGTTAGTTCAAG |
| 1127 | 2997422 | ANLN | TCAAGAACAACTATAAGCGGAGACC |
| 1128 | 2997422 | ANLN | ACCGACAGACGTCTATGATTTCTTC |
| 1129 | 2997423 | ANLN | ACGATGTTTGGATAACCTTTCGAA |
| 1130 | 2997423 | ANLN | CGATGTTTGGATAACCTTTCGGAAT |
| 1131 | 2997423 | ANLN | AACGATGTTTGGATAACCTTTCGGA |
| 1132 | 2997424 | ANLN | GACGCATCGAATGTCTGAATCGTAT |
| 1133 | 2997424 | ANLN | ATGCTTTCCCAAACACGGTTATAAG |
| 1134 | 2997424 | ANLN | AGAGTCATCAAAAAGCTTTCCGAC |
| 1135 | 2997424 | ANLN | CAGAAGAACCTCGACATCCAGAACT |
| 1136 | 3012979 | GNG11 | CGACGTCAGTGTAGGACGCGCCCAC |
| 1137 | 3012979 | GNG11 | GAGTCCAGGATCCTTCGACCCCGTG |
| 1138 | 3012979 | GNG11 | GCACTGTTCGCAGGGCCTCTTTCGG |
| 1139 | 3012979 | GNG11 | GGTCCGGAAGTCAACAAAGCCCTGC |
| 1140 | 3012980 | GNG11 | ACTTTTACCTTCAACTCGTCGAAGC |
| 1141 | 3012980 | GNG11 | TCAACTCGTCGAAGCGTTTCTTCAC |
| 1142 | 3012980 | GNG11 | ACCTTCAACTCGTCGAAGCGTTTCT |
| 1143 | 3012980 | GNG11 | TCGTCGAAGCGTTTCTTCACTTCAA |
| 1144 | 3012981 | GNG11 | TCTCCTAGGAGATCATTTCCCTTAA |
| 1145 | 3012981 | GNG11 | ACCTCCTAGGAGATCATTTCCCT |
| 1146 | 3012981 | GNG11 | CTCCTAGGAGATCATTTCCCTTAAG |
| 1147 | 3012981 | GNG11 | CCTCTCCTAGGAGATCATTTCCCTT |
| 1148 | 3012982 | GNG11 | CTGTGAAGAAAGTCATATAACGAAC |
| 1149 | 3012982 | GNG11 | CACGATGAGTAGAAACGAGTGATAC |
| 1150 | 3012982 | GNG11 | CTTGTAATGAACTCGTACTGTGAAG |
| 1151 | 3012982 | GNG11 | ACCCTCTTTGACGTAGGATTCACCT |
| 1152 | 3012983 | GNG11 | GAACCCGTACCGTGATGAGGTCAAG |
| 1153 | 3012983 | GNG11 | GAACCTGGGACGTGAGTACGAACG |
| 1154 | 3012983 | GNG11 | CGAAACTCTCGGTCATGAATAAGGA |
| 1155 | 3012983 | GNG11 | GGAGACCTTGCACAAACTAGATTGG |
| 1156 | 3012985 | GNG11 | GTAAATAAGGCCAATGACCGTTCCG |
| 1157 | 3012985 | GNG11 | CATGTGAGGGTTCAGGATCGAAAAC |
| 1158 | 3012985 | GNG11 | GGGATTGAACAACCCTCAACGCTAA |
| 1159 | 3012985 | GNG11 | GGTCGGTTGTACATCTTCACGTTAT |
| 1160 | 3428784 | DRAM1 | GAGGCATCAGCGCAGGCGAACCTCG |
| 1161 | 3428784 | DRAM1 | TGGCAGGCACTCACATGCGCGGGCC |
| 1162 | 3428784 | DRAM1 | GCCCGGCGAAACACTGAAGTGAGCA |
| 1163 | 3428784 | DRAM1 | TGAGCAAAGCGTTGTTCGGGCCCGT |
| 1164 | 3428785 | DRAM1 | CGACCCGCGTCGTGAGGCAGCCGCC |
| 1165 | 3428785 | DRAM1 | ACCCGCGTCGTGAGGCAGCCGCCGC |
| 1166 | 3428785 | DRAM1 | GGCGACCCGCGTCGTGAGGCAGCCG |
| 1167 | 3428785 | DRAM1 | CCCGCGTCGTGAGGCAGCCGCCGCC |
| 1168 | 3428786 | DRAM1 | GGAAGTAATAGAGGATGCACCAGCG |
| 1169 | 3428786 | DRAM1 | TGGACCAGCAGTCGGCGGAAGTAAT |
| 1170 | 3428786 | DRAM1 | GACACGAAGGACTCCCCTTACCGAA |
| 1171 | 3428786 | DRAM1 | TAGAGGATGCACCAGCGGCACGAGA |

TABLE 1-continued

PORTOS Target Sequences

| SEQ ID NO. | Affy Probeset ID | Gene | Sequence |
|---|---|---|---|
| 1172 | 3428798 | DRAM1 | AAACCTAAATACTATTTGAAGAGAC |
| 1173 | 3428798 | DRAM1 | AACCTAAATACTATTTGAAGAGACG |
| 1174 | 3428798 | DRAM1 | AAAACCTAAATACTATTTGAAGAGA |
| 1175 | 3428798 | DRAM1 | ACCTAAATACTATTTGAAGAGACGT |
| 1176 | 3428799 | DRAM1 | AATTGAACCACAGAAATCACGAACC |
| 1177 | 3428799 | DRAM1 | GGACGATAAAGTCGTGAGGACAAAA |
| 1178 | 3428799 | DRAM1 | ATCATGTCTTCGTTTTAGTTTGGAC |
| 1179 | 3428799 | DRAM1 | CGTCGGTGCTACATATGTTCTATGT |
| 1180 | 3428800 | DRAM1 | ACCTCACATACACAGACTTCTCTCG |
| 1181 | 3428800 | DRAM1 | CGTGTGAATACGGTAATATCGGTAA |
| 1182 | 3428800 | DRAM1 | GTCAATACTCCTCACCACCTCACAT |
| 1183 | 3428800 | DRAM1 | CTCCGTGTGAATACGGTAATATCGG |
| 1184 | 3428802 | DRAM1 | GGGTCACCTTGTCAGAGAGCTGTAC |
| 1185 | 3428802 | DRAM1 | AGACGGCAAAGAACGCGTCGACAGT |
| 1186 | 3428802 | DRAM1 | CACATGTGCGAGGATGTCAGGTAGT |
| 1187 | 3428802 | DRAM1 | AGAGCTGTACGGTGTATGCCTACCA |
| 1188 | 3428806 | DRAM1 | GTGATTAAAGGTATTGGTTCGACCT |
| 1189 | 3428806 | DRAM1 | TGATTAAAGGTATTGGTTCGACCTC |
| 1190 | 3428806 | DRAM1 | GATTAAAGGTATTGGTTCGACCTCA |
| 1191 | 3428809 | DRAM1 | ACTCAGAAAAGCCGATTTAAGACA |
| 1192 | 3428809 | DRAM1 | TCATACATGTAATTTCACTCAGAAA |
| 1193 | 3428809 | DRAM1 | GTAATTTCACTCAGAAAAGCCGAT |
| 1194 | 3428809 | DRAM1 | TCACTCAGAAAAGCCGATTTAAGA |
| 1195 | 3428812 | DRAM1 | GTGGGATTCCTATAGGTGTCTTTAG |
| 1196 | 3428812 | DRAM1 | CAGTGGGATTCCTATAGGTGTCTTT |
| 1197 | 3428812 | DRAM1 | TCACAGTGGGATTCCTATAGGTGTC |
| 1198 | 3428812 | DRAM1 | CACAGTGGGATTCCTATAGGTGTCT |
| 1199 | 3428813 | DRAM1 | GAGTGAGTCACTTACAGCGTCCGGT |
| 1200 | 3428813 | DRAM1 | TGGGACTAATAACCCTACGTAGACG |
| 1201 | 3428813 | DRAM1 | CGAGAACGACGATTAACGGGTAAGC |
| 1202 | 3428813 | DRAM1 | GGACGAGTACTCCAGCGTGGAAAAC |
| 1203 | 3428814 | DRAM1 | GTCGGTTCTTCTTGAAGACCCAAGT |
| 1204 | 3428814 | DRAM1 | TCGGTTCTTCTTGAAGACCCAAGTC |
| 1205 | 3428815 | DRAM1 | CCGACCTACAGGGTGTTGTGATATT |
| 1206 | 3428815 | DRAM1 | CAGTTCGGGAAACACAATTCGTTCT |
| 1207 | 3428815 | DRAM1 | TGAGGTAGAAAAGTGGGTTTAGTAC |
| 1208 | 3428815 | DRAM1 | ACGAGGAAGAGAAGTACGGACACCG |
| 1209 | 3428816 | DRAM1 | ACACCGGTTCACTCTAGTCGGGAGT |
| 1210 | 3428816 | DRAM1 | TCGTCGGGTACATCTGTCGAAGCCT |
| 1211 | 3428816 | DRAM1 | CAAGCCCATCGAGGAGTAATTGAT |
| 1212 | 3428816 | DRAM1 | GATCTCGTATTTGGGTACACACCGG |
| 1213 | 3428817 | DRAM1 | AAGAAATTCTGCGTAGTATTTACCA |
| 1214 | 3428817 | DRAM1 | ACGAAAGAAATTCTGCGTAGTATTT |
| 1215 | 3428817 | DRAM1 | GAAAGAAATTCTGCGTAGTATTTAC |
| 1216 | 3428817 | DRAM1 | GAAATTCTGCGTAGTATTTACCAAA |
| 1217 | 3428818 | DRAM1 | TCTGAAAACAAGAGCCGCGAGGAGT |
| 1218 | 3428818 | DRAM1 | AGGAGTGCTACCTCAAAGTACGAAG |
| 1219 | 3428818 | DRAM1 | GTGTTAATCTAACCCTCGAGGAACT |
| 1220 | 3428818 | DRAM1 | ACGGAGTGAAGCTCGTCTGAAAACA |
| 1221 | 3428832 | DRAM1 | TATTTTGGTATAAACTGACGTGGAA |
| 1222 | 3428832 | DRAM1 | ATACTTGGTGTGACTTTGCTGGAAG |
| 1223 | 3428832 | DRAM1 | ATCAGTTCACGACGTATTACAAAAC |
| 1224 | 3428832 | DRAM1 | TCAACTACCGTTGCTACCAATGAGT |
| 1225 | 3454842 | BIN2 | GGGACCCAAGAGTCATCCTTACGAC |
| 1226 | 3454842 | BIN2 | CTCTTTGATGGTTCTGAGGAGGACG |
| 1227 | 3454842 | BIN2 | AGTCTCCCTATATTCTCGGTCGTAG |
| 1228 | 3454842 | BIN2 | ACGACCACGACAGATTTCTGGACCG |
| 1229 | 3454844 | BIN2 | CTGGTCGAAGTTCAGAGGTACCATG |
| 1230 | 3454844 | BIN2 | TCTGGTCGAAGTTCAGAGGTACCAT |
| 1231 | 3454844 | BIN2 | TGGTCGAAGTTCAGAGGTACCATGG |
| 1232 | 3454844 | BIN2 | GGTCGAAGTTCAGAGGTACCATGGT |
| 1233 | 3454845 | BIN2 | ATTCGAATAGAGTCGATTGAGGAGC |
| 1234 | 3454845 | BIN2 | CCTATTATTCGAATAGAGTCGATTG |
| 1235 | 3454845 | BIN2 | ATTATTCGAATAGAGTCGATTGAGG |
| 1236 | 3454845 | BIN2 | TTCCTATTATTCGAATAGAGTCGAT |
| 1237 | 3454846 | BIN2 | TTGGTGGTCTCTTCGGTCATTCTTG |
| 1238 | 3454846 | BIN2 | AACATGAAGGGGTGGAATTACTGT |
| 1239 | 3454846 | BIN2 | TCGGTCATTCTTGAGGACTCCGGTT |
| 1240 | 3454846 | BIN2 | CTTTTGTAGGTGTTAGTCTTGGGAC |
| 1241 | 3454847 | BIN2 | ATGGAAGGTCGGGATGTCGGAGACC |
| 1242 | 3454847 | BIN2 | GTCGGGATCCCGGAGGAACCCCTGA |
| 1243 | 3454847 | BIN2 | CCTGGAGGGATCTCCAGAGAGGATT |
| 1244 | 3454847 | BIN2 | ACCCTGACGTTCAGGATCCTGGAGG |
| 1245 | 3454848 | BIN2 | TCTCTCGGAGATAGGTCTCCTGGAG |

TABLE 1-continued

PORTOS Target Sequences

| SEQ ID NO. | Affy Probeset ID | Gene | Sequence |
|---|---|---|---|
| 1246 | 3454848 | BIN2 | CTTCTCTCGGAGATAGGTCTCCTGG |
| 1247 | 3454848 | BIN2 | TTCTCTCGGAGATAGGTCTCCTGGA |
| 1248 | 3454849 | BIN2 | TGAGGTAGTGGTCCGCCTCGGGACT |
| 1249 | 3454849 | BIN2 | AGAGGATGGTGACTTTCCCGGTTCA |
| 1250 | 3454849 | BIN2 | GGTCGAGGTGTTGAGGTAGTGGTCC |
| 1251 | 3454849 | BIN2 | GATGGTGACTTTCCCGGTTCAGGGT |
| 1252 | 3454850 | BIN2 | CAGAGGTCAGGAGAATGGAGTGGAT |
| 1253 | 3454850 | BIN2 | TGTCGATGTCAGAGGTCAGGAGAAT |
| 1254 | 3454850 | BIN2 | CTTGTCGATGTCAGAGGTCAGGAGA |
| 1255 | 3454850 | BIN2 | AAGCTTGTCGATGTCAGAGGTCAGG |
| 1256 | 3454851 | BIN2 | GTCGTCCGCGAGAAATCAGTAAAGA |
| 1257 | 3454851 | BIN2 | TCCGCGAGAAATCAGTAAAGAGGGG |
| 1258 | 3454851 | BIN2 | CGTCCGCGAGAAATCAGTAAAGAGG |
| 1259 | 3454851 | BIN2 | CGCGAGAAATCAGTAAAGAGGGGGT |
| 1260 | 3454853 | BIN2 | GTAAAGGTTGAACTCCCTACAGAAG |
| 1261 | 3454853 | BIN2 | TAACCGACGATACACTGGTAGAAGG |
| 1262 | 3454853 | BIN2 | TGAACTCCCTACAGAAGATGTCCCT |
| 1263 | 3454853 | BIN2 | AGCATAACCGACGATACACTGGTAG |
| 1264 | 3454854 | BIN2 | TAAATCCTCGGAACCACCGACCAAA |
| 1265 | 3454854 | BIN2 | ACGGAATGAGCATACACAAACACCA |
| 1266 | 3454854 | BIN2 | TACCGAAAGTAAATCCTCGGAACCA |
| 1267 | 3454854 | BIN2 | GAAAGGGTACGGAATGAGCATACAC |
| 1268 | 3454855 | BIN2 | CTTCTCAAGTTGTTTCGGGTCTGAC |
| 1269 | 3454855 | BIN2 | TCTTGATGATCTCCTCGACGGATAA |
| 1270 | 3454855 | BIN2 | CTTCTAGACTTGGTTCTTGATGATC |
| 1271 | 3454855 | BIN2 | TCCTCGACGGATAAGAAATATTATC |
| 1272 | 3454856 | BIN2 | AGCCTTTGAGCACCTGATACTGTCA |
| 1273 | 3454856 | BIN2 | CCAGCCTTTGAGCACCTGATACTGT |
| 1274 | 3454856 | BIN2 | CCCAGCCTTTGAGCACCTGATACTG |
| 1275 | 3454856 | BIN2 | GCCCCAGCCTTTGAGCACCTGATAC |
| 1276 | 3454857 | BIN2 | TACAACGGGTCAAGTCACTTTAATT |
| 1277 | 3454857 | BIN2 | ATACAACGGGTCAAGTCACTTTAAT |
| 1278 | 3454857 | BIN2 | ACAACGGGTCAAGTCACTTTAATTC |
| 1279 | 3454858 | BIN2 | TTCACCTCGGAAGTGGTCGGAGACT |
| 1280 | 3454858 | BIN2 | GTGTGACACGTAAACACATCGGAGT |
| 1281 | 3454858 | BIN2 | CACCTAGGGAGATTAAAACTGGGAG |
| 1282 | 3454858 | BIN2 | CTGGAACACGGGACAAGAATTAGAG |
| 1283 | 3454859 | BIN2 | GTCGCTCACCCTGCCAGTACTCCTC |
| 1284 | 3454859 | BIN2 | TGTCGTCGCTCACCCTGCCAGTACT |
| 1285 | 3454859 | BIN2 | ACGTACTTTCAAGTTTTTCTCACAG |
| 1286 | 3454859 | BIN2 | TAGATGTCGTCGCTCACCCTGCCAG |
| 1287 | 3454860 | BIN2 | ACTTCTTGAAGGAATCACGTCAGTT |
| 1288 | 3454860 | BIN2 | TTCTTGAAGGAATCACGTCAGTTTC |
| 1289 | 3454860 | BIN2 | CTTCCGGTGTTCGACATGTTCCTGG |
| 1290 | 3454860 | BIN2 | GGTGTTCGACATGTTCCTGGACTTC |
| 1291 | 3454862 | BIN2 | CTTGCTAAACTTGTTTCGCGATCGT |
| 1292 | 3454862 | BIN2 | CTAAACTTGTTTCGCGATCGTTGAA |
| 1293 | 3454862 | BIN2 | TGCTAAACTTGTTTCGCGATCGTTG |
| 1294 | 3454862 | BIN2 | ACTTGCTAAACTTGTTTCGCGATCG |
| 1295 | 3454863 | BIN2 | GGATACCCTTCCAGATCGAGCTTTG |
| 1296 | 3454863 | BIN2 | GCACATCGGTCTGAAGCAATGAAGT |
| 1297 | 3454863 | BIN2 | CTCGTGACGAAACTCGGGACCCTTC |
| 1298 | 3454863 | BIN2 | GGTCGAGAGGGCTCAACTAAATAGT |
| 1299 | 3454864 | BIN2 | ACGTCTTCTTCAAATCGTCCCGGGT |
| 1300 | 3454864 | BIN2 | GCCGCGCCGGCCGGAGAAGCGGTTC |
| 1301 | 3454864 | BIN2 | TCTTCTTCAAATCGTCCCGGGTCCT |
| 1302 | 3454864 | BIN2 | CACGTCTTCTTCAAATCGTCCCGGG |
| 1303 | 3454865 | BIN2 | CGGCCCTCGGGCGTGAAGGAGGAGC |
| 1304 | 3454865 | BIN2 | TCTTTTGGTGTCCCGCGCCCCGGTC |
| 1305 | 3454865 | BIN2 | AGTCTTTTGGTGTCCCGCGCCCCGG |
| 1306 | 3454865 | BIN2 | GCCCTCGGGCGTGAAGGAGGAGCC |
| 1307 | 3454866 | BIN2 | CCGAATCTCGGATGGACCTCGTTCT |
| 1308 | 3454866 | BIN2 | AGGGATGGTCAAGGTCCGAATCTCG |
| 1309 | 3454866 | BIN2 | GAGTCTCTTGGATTTGCACAAAAGC |
| 1310 | 3454866 | BIN2 | TGCGTCACATGTACCGCCGAAGCGT |
| 1311 | 3536337 | CDKN3 | ATCTCCGGCTCAGAAGCCGGTGGGT |
| 1312 | 3536337 | CDKN3 | GCCTCATTCTTTGGTCTTCGCCTAG |
| 1313 | 3536337 | CDKN3 | GTGGAGTGTCTTCCTGCTTGGTCAC |
| 1314 | 3536337 | CDKN3 | AGCCGGTGGGTTTCCGCCTCATTCT |
| 1315 | 3536338 | CDKN3 | ACCAGAGCTGCACCCCGCCGGTCGC |
| 1316 | 3536338 | CDKN3 | CGCCGTGACCAGAGCTGCACCCCGC |
| 1317 | 3536338 | CDKN3 | GTGACCAGAGCTGCACCCCGCCGGT |
| 1318 | 3536338 | CDKN3 | CCTCCGCCGTGACCAGAGCTGCACC |
| 1319 | 3536343 | CDKN3 | AACATTTAAATTTCTACAATCTTCT |

TABLE 1-continued

PORTOS Target Sequences

| SEQ ID NO. | Affy Probeset ID | Gene | Sequence |
|---|---|---|---|
| 1320 | 3536343 | CDKN3 | ACATTTAAATTTCTACAATCTTCTT |
| 1321 | 3536344 | CDKN3 | TGTTCTGTATAAACAAAAGACGTGG |
| 1322 | 3536344 | CDKN3 | ACACCATATGTTCTGTATAAACAAA |
| 1323 | 3536344 | CDKN3 | TTCTGTATAAACAAAAGACGTGGTC |
| 1324 | 3536344 | CDKN3 | ACCATATGTTCTGTATAAACAAAAG |
| 1325 | 3536345 | CDKN3 | AGGGTTTGGAAGACCTAGAGATGGT |
| 1326 | 3536345 | CDKN3 | GGGTTTGGAAGACCTAGAGATGGTC |
| 1327 | 3536346 | CDKN3 | TGGGTAGTAGTAGGTTAGCGTCTAC |
| 1328 | 3536346 | CDKN3 | AGTAGTAGGTTAGCGTCTACCTCCC |
| 1329 | 3536346 | CDKN3 | GTTACACCTTAATAGTGGGTAGTAG |
| 1330 | 3536346 | CDKN3 | TAATAGTGGGTAGTAGTAGGTTAGC |
| 1331 | 3536347 | CDKN3 | CTTTATTACCTTCTCGAATGTTGGA |
| 1332 | 3536357 | CDKN3 | AGTGGTCTCGTTCGGTATCTGTCGG |
| 1333 | 3536357 | CDKN3 | CCTAGGCCCCGTTATGTCTGGTAGT |
| 1334 | 3536357 | CDKN3 | GTCGGACGCTCTGGATTCTCCTAGG |
| 1335 | 3536357 | CDKN3 | GACAGACTGTGTTATAGTGGTCTCG |
| 1336 | 3536358 | CDKN3 | GGTCAGGCAAAACCCTTACCTAGGA |
| 1337 | 3536358 | CDKN3 | TGAAGAGTCAAAAACGGGGTCAGGC |
| 1338 | 3536358 | CDKN3 | CAGGCAAAACCCTTACCTAGGAGAG |
| 1339 | 3536358 | CDKN3 | GCAAAACCCTTACCTAGGAGAGTGG |
| 1340 | 3536359 | CDKN3 | TTACTCTACCAATAACAATTATGTT |
| 1341 | 3536359 | CDKN3 | GTTACTCTACCAATAACAATTATGT |
| 1342 | 3536359 | CDKN3 | CTGTTACTCTACCAATAACAATTAT |
| 1343 | 3536359 | CDKN3 | TGTTACTCTACCAATAACAATTATG |
| 1344 | 3536360 | CDKN3 | TATGTTAATAGAAGTACTCAAAGCC |
| 1345 | 3536360 | CDKN3 | TGTTAATAGAAGTACTCAAAGCCCT |
| 1346 | 3536360 | CDKN3 | GTTATGTTAATAGAAGTACTCAAAG |
| 1347 | 3536360 | CDKN3 | GTTAATAGAAGTACTCAAAGCCCTG |
| 1348 | 3536361 | CDKN3 | AAGTGTTAGTTCTAGACATAGTTCT |
| 1349 | 3536361 | CDKN3 | TGTTAGTTCTAGACATAGTTCTATT |
| 1350 | 3536361 | CDKN3 | GTGTTAGTTCTAGACATAGTTCTAT |
| 1351 | 3536361 | CDKN3 | TAAGTGTTAGTTCTAGACATAGTTC |
| 1352 | 3536362 | CDKN3 | ACGTCTATAAGGATTTCAAAATAAC |
| 1353 | 3536362 | CDKN3 | TTACTTTGGTGGTCACAATAGTTGA |
| 1354 | 3536362 | CDKN3 | TTACATGTACACGTCTATAAGGATT |
| 1355 | 3536362 | CDKN3 | CTTTACAGTCAAGAGATCGTATTAA |
| 1356 | 3599812 | KIF23 | GGCGCGGAATCGGCGCTTCAAGATC |
| 1357 | 3599812 | KIF23 | ACCGGGCAAACTTTACGCGGTCCGC |
| 1358 | 3599812 | KIF23 | CCGAAGCGTCTCGTGGCGCGGAATC |
| 1359 | 3599812 | KIF23 | CCCGAGAATCGCAGCGGCGGCCGAA |
| 1360 | 3599813 | KIF23 | AGGGCGTACGCGCAAACCCGCCGCA |
| 1361 | 3599813 | KIF23 | GTCGGCAGGGCGTACGCGCAAACCC |
| 1362 | 3599813 | KIF23 | GCGTCAGAAGCGGTCGGTCGGCAGG |
| 1363 | 3599813 | KIF23 | AAGAACGACGGCCAGGATTGCAGGG |
| 1364 | 3599815 | KIF23 | CCCGATGTCTGAGTTGGCTTTACCT |
| 1365 | 3599815 | KIF23 | CCCGAAAGGACTAGTTCTCACAACG |
| 1366 | 3599815 | KIF23 | GTCGAAGTATGAGGACTCCCGATGT |
| 1367 | 3599815 | KIF23 | ATCCCACGCGGGTGACCCGAAAGGA |
| 1368 | 3599816 | KIF23 | TGGTGGGTCTTCCTTGAGAAACTAC |
| 1369 | 3599816 | KIF23 | TTCATAAACCGTGAGTGTGGTGGGT |
| 1370 | 3599816 | KIF23 | TTACTGGAGTAAGTACCGTTTTTAC |
| 1371 | 3599816 | KIF23 | CTACAACACCGATTAGGGAACCAGT |
| 1372 | 3599817 | KIF23 | GAGTGTGTTACTGACCAAGAGGTCC |
| 1373 | 3599817 | KIF23 | GGAGCAACAAACCTGTACTAGAAAT |
| 1374 | 3599817 | KIF23 | GTATACCACACTGCCCTTCACCTTT |
| 1375 | 3599817 | KIF23 | ATCCCAGTAAAGTTCGATTTGCTAT |
| 1376 | 3599818 | KIF23 | TTTCTCTTCGATACGGGTTAGGTTT |
| 1377 | 3599818 | KIF23 | TATATGTCACACTCCAACTACGGAA |
| 1378 | 3599818 | KIF23 | CTACGGAATAATCTTGCAGTCTTTT |
| 1379 | 3599818 | KIF23 | CAAAAGTTTAGATTACTATCCTTAT |
| 1380 | 3599819 | KIF23 | TTTTACCTGAATATTGCATATGTTA |
| 1381 | 3599819 | KIF23 | AATTTTACCTGAATATTGCATATGT |
| 1382 | 3599819 | KIF23 | CTGAATATTGCATATGTTAACTTGA |
| 1383 | 3599819 | KIF23 | ACCTGAATATTGCATATGTTAACTT |
| 1384 | 3599820 | KIF23 | ATACTATTGACATGTTCTTAAGACG |
| 1385 | 3599820 | KIF23 | CTTCTCCACGGCAAACTAGGGTATT |
| 1386 | 3599820 | KIF23 | TCTATCACAGATACCACATAAACAG |
| 1387 | 3599820 | KIF23 | TGCTGTTCATCTAGGTCTCAAACGT |
| 1388 | 3599822 | KIF23 | CAGTGAACCGCAAAATCAGGATCAG |
| 1389 | 3599822 | KIF23 | ATAAAGAGACCTCATAATATGCAAT |
| 1390 | 3599822 | KIF23 | CTATGGTCGTAGAGTATTAAATCCT |
| 1391 | 3599822 | KIF23 | TCAGGATCAGAATTTACTTCTATGG |
| 1392 | 3599823 | KIF23 | TACAACGTCCTACATGTCTTCAACT |
| 1393 | 3599823 | KIF23 | GGAGGTGTTAGATTTAACGAAGCAC |

TABLE 1-continued

PORTOS Target Sequences

| SEQ ID NO. | Affy Probeset ID | Gene | Sequence |
|---|---|---|---|
| 1394 | 3599823 | KIF23 | AACGAAGCACTTCTATTCTTGGTAT |
| 1395 | 3599823 | KIF23 | AACTTCACTTTAGATGACTCCTCCG |
| 1396 | 3599824 | KIF23 | AAACTGAATAATCTTTCGTACATAT |
| 1397 | 3599824 | KIF23 | AGTGGATCTCAACGATGATTCAAAC |
| 1398 | 3599824 | KIF23 | CGATGATTCAAACTACCGTTAAAAA |
| 1399 | 3599824 | KIF23 | ACTACTTATAGTGGATCTCAACGAT |
| 1400 | 3599825 | KIF23 | TAATTTAATCAAGTCCGAGGGAACC |
| 1401 | 3599825 | KIF23 | TGGGTAAACTTAGCACTCAGGTCGG |
| 1402 | 3599825 | KIF23 | CTCTGCATAACGATTATGGGTAAAC |
| 1403 | 3599825 | KIF23 | GCAAGGGTATCGCACAAGTTGTAAT |
| 1404 | 3599826 | KIF23 | GTCTTCCCTTGTCTAATGCACTTCG |
| 1405 | 3599826 | KIF23 | CACTTTCTTGATTGGCCTGGTCTCG |
| 1406 | 3599826 | KIF23 | GAACCATCTAGAACGACCTTCACTT |
| 1407 | 3599826 | KIF23 | TCTTGTTTAGTGATATTCAGTCAAC |
| 1408 | 3599828 | KIF23 | GTTTCAATTGGGTAGACAAGTTCTT |
| 1409 | 3599828 | KIF23 | ACGCCTACTAGCACACACTTGGG |
| 1410 | 3599828 | KIF23 | CCAAGGTATAGCTCTAAGTTTCAAT |
| 1411 | 3599828 | KIF23 | AGTTCTTGATGAAACTACCCCTTCC |
| 1412 | 3599830 | KIF23 | TGGTAACCAATGACTGCACCAAAAC |
| 1413 | 3599830 | KIF23 | GTAACCAATGACTGCACCAAAACGT |
| 1414 | 3599830 | KIF23 | GGTAACCAATGACTGCACCAAAACG |
| 1415 | 3599830 | KIF23 | TAACCAATGACTGCACCAAAACGTC |
| 1416 | 3599831 | KIF23 | CTATAGTTGCTACTCGTCTGTGAAG |
| 1417 | 3599831 | KIF23 | TCTGTGAAGGTTCCGACTAACTTCG |
| 1418 | 3599831 | KIF23 | TAACTTCGGAATCTCTTTGCTGTAT |
| 1419 | 3599831 | KIF23 | GGAAACGGTAGTACGCTTTAAAACC |
| 1420 | 3599832 | KIF23 | TTACGAAAATTTCGAAACAATGTTC |
| 1421 | 3599832 | KIF23 | GATTACGAAAATTTCGAAACAATGT |
| 1422 | 3599832 | KIF23 | ATTACGAAAATTTCGAAACAATGTT |
| 1423 | 3599833 | KIF23 | TTCTTTTGGTGTACGTTCCCTTGA |
| 1424 | 3599836 | KIF23 | TCTATTTGCGTTAAACGTTGTCCTT |
| 1425 | 3599836 | KIF23 | TGTTGATGATAGATACTCCTTCTAT |
| 1426 | 3599836 | KIF23 | ACCACTGTCTTTGCTGTTACTTCAC |
| 1427 | 3599836 | KIF23 | ACTGTTTGCGTCTAATCTTCGGTCC |
| 1428 | 3599837 | KIF23 | CATCTCACCGTCGGTTTGTCGACCT |
| 1429 | 3599837 | KIF23 | TCGCATCTCACCGTCGGTTTGTCGA |
| 1430 | 3599837 | KIF23 | CGACCTCTACGTCTTATTTGAGACC |
| 1431 | 3599837 | KIF23 | CTCACCGTCGGTTTGTCGACCTCTA |
| 1432 | 3599838 | KIF23 | GTCTCTCTGGGAGAGCCCTCGCTCT |
| 1433 | 3599838 | KIF23 | CTCGCTCTAGCTCTTTTTCAATGAG |
| 1434 | 3599838 | KIF23 | TTCGACTTTGTTGACTTCCGATAAC |
| 1435 | 3599838 | KIF23 | GACTTCCGATAACAATGGCTTGGAT |
| 1436 | 3599839 | KIF23 | CCCTCCACCAAGGATGTAAGTCTTT |
| 1437 | 3599839 | KIF23 | GTAGATAACGTTCCGCATCCGTCGT |
| 1438 | 3599839 | KIF23 | GTCGGTGTCGATGTATCCGCGAGAT |
| 1439 | 3599839 | KIF23 | TCCGCGAGATTGAGAACGTCGTCGT |
| 1440 | 3599841 | KIF23 | AGACAAAACAAATCTTCGGATCTTT |
| 1441 | 3599841 | KIF23 | GGAGAGTTATCGTCCCTATTTATAA |
| 1442 | 3599841 | KIF23 | AACACCTGTATTATCTAATGGAGAG |
| 1443 | 3599841 | KIF23 | TCCTTTCTGAACGTCGTAATGGTCT |
| 1444 | 3599842 | KIF23 | ATTTAATTAAGACCCAATACGAACA |
| 1445 | 3599842 | KIF23 | TTAATTAAGACCCAATACGAACAAA |
| 1446 | 3599842 | KIF23 | AATTAAGACCCAATACGAACAAAGA |
| 1447 | 3599842 | KIF23 | TAATTAAGACCCAATACGAACAAAG |
| 1448 | 3599843 | KIF23 | CGGAGGCTACCCCTCTAACTTTGAT |
| 1449 | 3599843 | KIF23 | TCTGCTAGTGCGAGACGTCCTCTGT |
| 1450 | 3599843 | KIF23 | ACCCATCTAGTATTCGGCGGAGAT |
| 1451 | 3599843 | KIF23 | GGAGTACGGTAGTGTCATAGACAAC |
| 1452 | 3599845 | KIF23 | GTTCCCCACCACCTGTTAGACAAGT |
| 1453 | 3599845 | KIF23 | TTTTGTTCCCCACCACCTGTTAGAC |
| 1454 | 3599845 | KIF23 | CAAATGACTATAACTCTGAAATTTC |
| 1455 | 3599845 | KIF23 | CCCACCACCTGTTAGACAAGTCAAA |
| 1456 | 3599849 | KIF23 | CTTTTTAATTTATAAACAGACGGAT |
| 1457 | 3599850 | KIF23 | ATGGACCTACTGGATTTCTGGAAAG |
| 1458 | 3599850 | KIF23 | CTGGAAAGACCGAGTGTTGTAAACA |
| 1459 | 3599850 | KIF23 | GATAACTCTCCTCGACTAGAAAAAG |
| 1460 | 3599850 | KIF23 | TGGATCCACACCTCGGACGATTTAT |
| 1461 | 3599851 | KIF23 | ACCTATAGTCGTAGTGCGTGTTGGG |
| 1462 | 3599851 | KIF23 | CTATAGTCGTAGTGCGTGTTGGGTT |
| 1463 | 3599851 | KIF23 | CCTATAGTCGTAGTGCGTGTTGGGT |
| 1464 | 3599852 | KIF23 | AACTTTTAGTGCCTGGAGTCGATGT |
| 1465 | 3599852 | KIF23 | TACCAAGGTTTCTGTTGATCATAAG |
| 1466 | 3599852 | KIF23 | GAGCTTTCGGTACGGTCTTCGTCAG |
| 1467 | 3599852 | KIF23 | TCTCGTTTCGAAAGGGATACCAAGG |

TABLE 1-continued

PORTOS Target Sequences

| SEQ ID NO. | Affy Probeset ID | Gene | Sequence |
|---|---|---|---|
| 1468 | 3599853 | KIF23 | TGTAAATCTATACGGTTTTCTTAAT |
| 1469 | 3599853 | KIF23 | AAATCTATACGGTTTTCTTAATTTT |
| 1470 | 3599853 | KIF23 | ACTGTAAATCTATACGGTTTTCTTA |
| 1471 | 3599853 | KIF23 | AGACTGTAAATCTATACGGTTTTCT |
| 1472 | 3726377 | EME1 | CTCCTCAACGGTTGTAAACGGAAAG |
| 1473 | 3726377 | EME1 | CATCACCAACTGTAGAGTCTAACAC |
| 1474 | 3726377 | EME1 | TCAATAAAAGTGGTGGACAGGGTCT |
| 1475 | 3726377 | EME1 | GTCGGTCAGTCCAACGATTCGTCAC |
| 1476 | 3726378 | EME1 | AGGTACTATGGGGTCTCTCCTCACG |
| 1477 | 3726378 | EME1 | ACGTCGTCTATTGTTCCTGGACTAG |
| 1478 | 3726378 | EME1 | GACTAGAATCTAGGTACGACAGTCG |
| 1479 | 3726378 | EME1 | TCGGGAAAGGTTTCTAGGGACTTCA |
| 1480 | 3726379 | EME1 | TACGTCGTGACCAATGGTCCTACTT |
| 1481 | 3726379 | EME1 | TGTTCGTTCCGTCTTCCTTTCGTGG |
| 1482 | 3726379 | EME1 | TGTGTAGTAACATCACGACCTAGGT |
| 1483 | 3726379 | EME1 | TCTTTTGGTTCGGCTCAGTCTTCCA |
| 1484 | 3726381 | EME1 | CGTGACGTCTGGTACCTCACGGCGA |
| 1485 | 3726381 | EME1 | GGATCCTCGTGACGTCTGGTACCTC |
| 1486 | 3726381 | EME1 | CCACCCCGGTCGAGGATCCTCGTG |
| 1487 | 3726381 | EME1 | TTCCACCCCGGTCGAGGATCCTCG |
| 1488 | 3726382 | EME1 | TCCGACACGGAACGTCACAGTGAAC |
| 1489 | 3726382 | EME1 | ACACGGAACGTCACAGTGAACCTCC |
| 1490 | 3726382 | EME1 | GCGTCCGACACGGAACGTCACAGTG |
| 1491 | 3726382 | EME1 | CGACACGGAACGTCACAGTGAACCT |
| 1492 | 3726383 | EME1 | GTAAACACAGGTACTAGCTGTTACC |
| 1493 | 3726383 | EME1 | CCTCGGTTGTCATGACCACAACGAG |
| 1494 | 3726383 | EME1 | TCCGTAAACACAGGTACTAGCTGTT |
| 1495 | 3726383 | EME1 | GTCATGACCACAACGAGGCCCGTCT |
| 1496 | 3726384 | EME1 | CCTTCGGACCTGTCGTGATACTTTC |
| 1497 | 3726385 | EME1 | CTTCCTTTGCGAAGTCCCGAAACAT |
| 1498 | 3726385 | EME1 | CGTCCCTTTCGAGACAGTGACCACT |
| 1499 | 3726386 | EME1 | CAGTGAGACGTTCCATCAGGTAGAG |
| 1500 | 3726386 | EME1 | AAAGTACAATTTTCCCCGTCGAGAA |
| 1501 | 3726386 | EME1 | CCCTACGAGACCAGGTCAGAAGAAG |
| 1502 | 3726386 | EME1 | ATAAGTAACGTCTACATCCAGTGAG |
| 1503 | 3726387 | EME1 | GGACCTCGACGACAAGAAACTAAAG |
| 1504 | 3726387 | EME1 | AGAAACTAAAGGAGGGGACGTGGTC |
| 1505 | 3726387 | EME1 | CTCGACGACAAGAAACTAAAGGAGG |
| 1506 | 3726387 | EME1 | CGACGACAAGAAACTAAAGGAGGGG |
| 1507 | 3726388 | EME1 | TACCATAGGTCCCATCTGCGACTTC |
| 1508 | 3726388 | EME1 | TCTCCGGTCGTATCCCAGGTACCAT |
| 1509 | 3726388 | EME1 | AGGTACCATAGGTCCCATCTGCGAC |
| 1510 | 3726388 | EME1 | GTATCCCAGGTACCATAGGTCCCAT |
| 1511 | 3726389 | EME1 | GACCTTTCTCGACCGGCTGAAGTGT |
| 1512 | 3726389 | EME1 | GACCGGCTGAAGTGTACGCGTAAGT |
| 1513 | 3726389 | EME1 | CGGGTCCGAGTTTAACACGTCTCGA |
| 1514 | 3726389 | EME1 | TCCGAGTTTAACACGTCTCGACCTT |
| 1515 | 3726390 | EME1 | GTCCGACTATAGTATCCGGTCCAAT |
| 1516 | 3726390 | EME1 | ACTCCGGACTTCTCTAACTGAACAG |
| 1517 | 3726390 | EME1 | GGTATCCGGTTCAATGGTCCTAATT |
| 1518 | 3726390 | EME1 | AAAGTCAACGGTGAACTCCCCTTGT |
| 1519 | 3726391 | EME1 | ACGTCAACACTTACGGATAGGGAGG |
| 1520 | 3726391 | EME1 | CCTGAGCGTGATCAGACCTCCTCTG |
| 1521 | 3726391 | EME1 | TAAGTCGTCGACTTGGCTCAGTCGG |
| 1522 | 3726391 | EME1 | TCGAGGCTCTACTTTGATGGAAGAG |
| 1523 | 3726392 | EME1 | CTTGCGGTCTTAAACGAGCGTCTGT |
| 1524 | 3726392 | EME1 | CACTGTAGGTGAAGAGCGGCGTAAC |
| 1525 | 3726392 | EME1 | CTGGTCTTGATAGGTCCGCATAGAT |
| 1526 | 3726392 | EME1 | TAGTCGTCACAAAAAGCCTATTTCT |
| 1527 | 3726393 | EME1 | ACCGTAAATTACAAGGAGAGGACCG |
| 1528 | 3726393 | EME1 | GGTTCCTTGCCCTAATACTACTGAT |
| 1529 | 3726393 | EME1 | CTACTGATACGCCTGAAGATATAAC |
| 1530 | 3726393 | EME1 | CTCCGGGTCAGAAAGAACCCAGAAT |
| 1531 | 3756194 | TOP2A | GCCCCTGTTGTAAACTAGGTTCTAG |
| 1532 | 3756194 | TOP2A | ACGAGTCGTTACTCGATAATCTAAG |
| 1533 | 3756194 | TOP2A | TCTGGACAGATGTAACAATATACAC |
| 1534 | 3756194 | TOP2A | GACCTAACGTCTTCTGAGCCCTGT |
| 1535 | 3756195 | TOP2A | TCACTGGTAGAGTACCCGTAACAAA |
| 1536 | 3756195 | TOP2A | AAGAGTTTAGTAGTCTCCGGCTTCT |
| 1537 | 3756195 | TOP2A | GACTAGTGAAGTCGCATTTCGTCAC |
| 1538 | 3756195 | TOP2A | TGTGAAACCGACACAGATATTGAAC |
| 1539 | 3756196 | TOP2A | TAGACATGCCCGTTTCTTTGGATAT |
| 1540 | 3756196 | TOP2A | GGTATACCTGAAACTGAGTCGACAC |
| 1541 | 3756196 | TOP2A | CGAGGAGCCCGTTTTAGACATGCCC |

TABLE 1-continued

PORTOS Target Sequences

| SEQ ID NO. | Affy Probeset ID | Gene | Sequence |
|---|---|---|---|
| 1542 | 3756196 | TOP2A | GTTCCCCCTCTCACTACTGAAGGTA |
| 1543 | 3756197 | TOP2A | ACAAAGCTTTCGTCAGTGTTCGTTC |
| 1544 | 3756197 | TOP2A | GACCACAGAGAGTTTTCGGACTAGG |
| 1545 | 3756197 | TOP2A | ACGGTTTTGGTTCTTAGCGGCGTTT |
| 1546 | 3756197 | TOP2A | AGCGGCGTTTTCCTTCGGTAGGTGA |
| 1547 | 3756198 | TOP2A | TCAAGGATTTTTCTTACACTGTCAC |
| 1548 | 3756198 | TOP2A | CAAGGATTTTTCTTACACTGTCACT |
| 1549 | 3756198 | TOP2A | GATTTTTCTTACACTGTCACTTCTT |
| 1550 | 3756198 | TOP2A | AGGATTTTTCTTACACTGTCACTTC |
| 1551 | 3756199 | TOP2A | ACATGGTGACAGAAGTTCGGGAGGA |
| 1552 | 3756199 | TOP2A | CCGTCACATGGTGACAGAAGTTCGG |
| 1553 | 3756199 | TOP2A | TTCGGGAGGACGATGTGTAAAGGGT |
| 1554 | 3756199 | TOP2A | TCGGGAGGACGATGTGTAAAGGGTC |
| 1555 | 3756200 | TOP2A | AATCATTGTTTCTTGACTTTGGTGT |
| 1556 | 3756200 | TOP2A | CTTTGGTGTCTTTTCACAGCACAGT |
| 1557 | 3756200 | TOP2A | TTTGGTGTCTTTTCACAGCACAGTC |
| 1558 | 3756200 | TOP2A | ATCATTGTTTCTTGACTTTGGTGTC |
| 1559 | 3756201 | TOP2A | ACTACTTCTAAAACAGGGTAGTCTA |
| 1560 | 3756202 | TOP2A | TGTTTGATGTAACCGTAAATTCGGT |
| 1561 | 3756202 | TOP2A | TCTCTTTAGGGACCAGACTAAGTCT |
| 1562 | 3756202 | TOP2A | CATTAAAACTACAGGGAGGTGCTCT |
| 1563 | 3756202 | TOP2A | AGTCTATCCTCGTCACTGCTTTCAT |
| 1564 | 3756203 | TOP2A | ACACCTTGATCTTCCGGATTTTGTT |
| 1565 | 3756203 | TOP2A | GATCTTCCGGATTTTGTTTCTAATC |
| 1566 | 3756203 | TOP2A | TCTACCACACCTTGATCTTCCGGAT |
| 1567 | 3756203 | TOP2A | TTTTATGACTTCCTTCGGGAGTTCT |
| 1568 | 3756204 | TOP2A | TTGTTCTACTTGTTCAGCCTGAAGG |
| 1569 | 3756204 | TOP2A | CCAGTTTCTCAGTAAGGTGCTTATT |
| 1570 | 3756204 | TOP2A | ACGGAAGAGGCGCACCAGTTTCTCA |
| 1571 | 3756204 | TOP2A | AAGGTGCTTATTGGTATCTTTACTT |
| 1572 | 3756206 | TOP2A | GGAAGTTGATAGAAGAACTATACGG |
| 1573 | 3756206 | TOP2A | ACTATACGGGGAAACCATAAATTGG |
| 1574 | 3756206 | TOP2A | ACTGAGGCATTGTCTAAGACCTGGT |
| 1575 | 3756206 | TOP2A | GTCTAAGACCTGGTTGGAAGTTGAT |
| 1576 | 3756207 | TOP2A | TACTTCTCTCACTGTTGCTTTTCCT |
| 1577 | 3756207 | TOP2A | ACTTCTCTCACTGTTGCTTTTCCTT |
| 1578 | 3756207 | TOP2A | TTACTTCTCTCACTGTTGCTTTTCC |
| 1579 | 3756207 | TOP2A | CTTCTCTCACTGTTGCTTTTCCTTT |
| 1580 | 3756208 | TOP2A | AAGTCTCCCCTATACTAAGCCTAGG |
| 1581 | 3756208 | TOP2A | AAGACTAAGTCTCCCCTATACTAAG |
| 1582 | 3756208 | TOP2A | CTATACTAAGCCTAGGACACTTCCG |
| 1583 | 3756208 | TOP2A | TAATTAATTTCAAGACTAAGTCTCC |
| 1584 | 3756209 | TOP2A | CTCTGAAAAACTTGAGTCTGAATT |
| 1585 | 3756209 | TOP2A | TTAGTCCGAGCGAAATAGAATCTCT |
| 1586 | 3756209 | TOP2A | TTACCGAGGATCCTTACGAACCACG |
| 1587 | 3756209 | TOP2A | CGAAAAACTGGTGCATCCGACAAAT |
| 1588 | 3756210 | TOP2A | TGTTTCAGAAGTTTGAGGTTTGATC |
| 1589 | 3756210 | TOP2A | GGAGGAGAGTATTGTCTGATATCCC |
| 1590 | 3756210 | TOP2A | CGTCTCTCTCAACCTGATGTGTTTC |
| 1591 | 3756210 | TOP2A | CTGATATCCCTTATGGTATGTCTAT |
| 1592 | 3756211 | TOP2A | ACCGAGGTTTAGTTATACACTAATC |
| 1593 | 3756211 | TOP2A | TGTTGGTAACTTTAGAGTCTCGAAG |
| 1594 | 3756211 | TOP2A | AGTTCCCATGATAACTTCTTGACCG |
| 1595 | 3756211 | TOP2A | AGTCTCGAAGGGCAGTCTTGTACCT |
| 1596 | 3756212 | TOP2A | GCACAACTCGGACTTACCATGTAAG |
| 1597 | 3756212 | TOP2A | CATGACCCACCAGGACGTTTTAGGG |
| 1598 | 3756212 | TOP2A | CCGAGCTAACAATAAAGGTGGTTTT |
| 1599 | 3756212 | TOP2A | GGGTTGAAACTACACGCACTTTAAC |
| 1600 | 3756213 | TOP2A | CGTTCCTAAGACGATCAGGTGCTAT |
| 1601 | 3756213 | TOP2A | CTGGTAATAGTTAAACCGAGTCTTA |
| 1602 | 3756213 | TOP2A | GTCGGGTAACCAGTCAAACCATGGT |
| 1603 | 3756213 | TOP2A | GGTCCGATGTACCACCGTTCCTAAG |
| 1604 | 3756214 | TOP2A | CTTCATTTCCAACGGGTTAATCGAC |
| 1605 | 3756214 | TOP2A | ACTGTTCGCTCTTCATTTCCAACGG |
| 1606 | 3756214 | TOP2A | ACAAATGAACGAAGTTTGCCTTACT |
| 1607 | 3756214 | TOP2A | GTTTGCCTTACTGTTCGCTCTTCAT |
| 1608 | 3756215 | TOP2A | AGTTAAGACTATTGCTCTCTAGAT |
| 1609 | 3756215 | TOP2A | TCTAGATAGGGAAGATACCACCTAC |
| 1610 | 3756215 | TOP2A | GAAGTAGTTGTTCCTTGAATAGAAC |
| 1611 | 3756215 | TOP2A | AGACTGTATATTACTGAAGTAGTTG |
| 1612 | 3756216 | TOP2A | CTACTAGCTTTCCTTACCAATTGAT |
| 1613 | 3756216 | TOP2A | GTTGCTTTCAATGAACCCGAAGGAC |
| 1614 | 3756216 | TOP2A | CAATTGATTAAAGTACCTCCTATCT |
| 1615 | 3756216 | TOP2A | TTGTCTATCTACTAGCTTTCCTTAC |

TABLE 1-continued

PORTOS Target Sequences

| SEQ ID NO. | Affy Probeset ID | Gene | Sequence |
|---|---|---|---|
| 1616 | 3756217 | TOP2A | GGTCGTGTAGTTTCCTTCGATTTCT |
| 1617 | 3756217 | TOP2A | CTTTTCTGTAGCATAGGTCAAGTTT |
| 1618 | 3756217 | TOP2A | CTTCGATTTCTTATGAAACGTCTAT |
| 1619 | 3756217 | TOP2A | AGCATAGGTCAAGTTTATAAGACCA |
| 1620 | 3756218 | TOP2A | TTCTCACCTTCTCAAGATGAGGTTT |
| 1621 | 3756218 | TOP2A | TCTCACCTTCTCAAGATGAGGTTTA |
| 1622 | 3756218 | TOP2A | CTTCTCACCTTCTCAAGATGAGGTT |
| 1623 | 3756219 | TOP2A | AGACGCTGTAGCAAAAGACCTCCTT |
| 1624 | 3756219 | TOP2A | ACGCTGTAGCAAAAGACCTCCTTAA |
| 1625 | 3756219 | TOP2A | ACCGGGAGAGAAGACGCTGTAGCAA |
| 1626 | 3756219 | TOP2A | GAGAGAAGACGCTGTAGCAAAAGAC |
| 1627 | 3756220 | TOP2A | TTATAGTAGTTCTAACACCCAGAAG |
| 1628 | 3756220 | TOP2A | GTAACTTCTGCGAAGCAATACCCTT |
| 1629 | 3756220 | TOP2A | TTCTAACACCCAGAAGTCATGTTCT |
| 1630 | 3756220 | TOP2A | CTAAGTAACTTCTGCGAAGCAATAC |
| 1631 | 3756221 | TOP2A | ACAAGCTCTTCGAAGAGTATTCGTC |
| 1632 | 3756221 | TOP2A | ACCCTCTCTGTTTATACCCCAAAAG |
| 1633 | 3756221 | TOP2A | TTTTATGAGTTACAAGCTCTTCGAA |
| 1634 | 3756222 | TOP2A | ACTCCCTCTAAGTCGGTTTTGAAAC |
| 1635 | 3756222 | TOP2A | CCCTCTAAGTCGGTTTTGAAACCGA |
| 1636 | 3756222 | TOP2A | GAGGTGACTCACATGCGAATAGGAC |
| 1637 | 3756222 | TOP2A | GCGAATAGGACTGACTCCCTCTAAG |
| 1638 | 3756223 | TOP2A | CTTAGTTCCCTTAAGGGTTTGAGCT |
| 1639 | 3756223 | TOP2A | CAATTTGTTCTTCACAAGTCGACAT |
| 1640 | 3756223 | TOP2A | GTAACCGACACCATAACATCTTTCG |
| 1641 | 3756223 | TOP2A | ACATCTTTCGTATGATTTGACCCAC |
| 1642 | 3756224 | TOP2A | AACTTTTGGGTTGGAAACTGAGAGT |
| 1643 | 3756224 | TOP2A | TTTTGTACTGAAATGTTGGGTTCTC |
| 1644 | 3756224 | TOP2A | TTGGGTTGGAAACTGAGAGTCTGTT |
| 1645 | 3756224 | TOP2A | ACATTTACGGAATTAACTTTTGGGT |
| 1646 | 3756225 | TOP2A | ACCACAACGTCATTTTCGTGTAGTC |
| 1647 | 3756225 | TOP2A | CTAACACTGATTTGAACAACTACAA |
| 1648 | 3756225 | TOP2A | TGTTCCCACCACAACGTCATTTTCG |
| 1649 | 3756225 | TOP2A | CGACTAGTCTAACACTGATTTGAAC |
| 1650 | 3756226 | TOP2A | GGTGTCCACCCTTCACACAAATTGA |
| 1651 | 3756226 | TOP2A | TTTCCTAAAGCATCAATACACCTGT |
| 1652 | 3756226 | TOP2A | GTTCAACCTACTTTGACCATTGAGG |
| 1653 | 3756226 | TOP2A | TCCGAAAGTCGTTTAATCGAAACAG |
| 1654 | 3756227 | TOP2A | ATATGTACATAGTGGAAAGTCGGAC |
| 1655 | 3756227 | TOP2A | ATAACGACCTAGGTGGTTTCTACAG |
| 1656 | 3756227 | TOP2A | TTACGTTTCGGACCTGTTTCTATAA |
| 1657 | 3756227 | TOP2A | AACAACGTGATTACCAGTCTTCTCG |
| 1658 | 3756228 | TOP2A | CCGATACCTCGGTTTAACACATTGT |
| 1659 | 3756228 | TOP2A | CATTGTATAAGTCATGGTTTAAATG |
| 1660 | 3756228 | TOP2A | ACCGATACCTCGGTTTAACACATTG |
| 1661 | 3756229 | TOP2A | ACTTTTCTACATACAGGGTCGAGAG |
| 1662 | 3756229 | TOP2A | AAACCTGTCGAGGATTGAAGATCAT |
| 1663 | 3756229 | TOP2A | GTCGAGGATTGAAGATCATTGATAC |
| 1664 | 3756229 | TOP2A | GAGTATAAACCTGTCGAGGATTGAA |
| 1665 | 3756230 | TOP2A | GAACATAATCTCAGTGTTAACTAGG |
| 1666 | 3756230 | TOP2A | CCTGGGTTTTACAGAACATAATCT |
| 1667 | 3756230 | TOP2A | ATTACGACGCCTGTTGTTTGTTTCC |
| 1668 | 3756230 | TOP2A | ACGCCTGTTGTTTGTTTCCCTGGGT |
| 1669 | 3756232 | TOP2A | GCGGGTCTGTGGATGTAACCAAGAC |
| 1670 | 3756232 | TOP2A | GTGGATGTAACCAAGACACCTTAAT |
| 1671 | 3756232 | TOP2A | ACCAAGACACCTTAATCACTGGGTC |
| 1672 | 3756232 | TOP2A | CTTGTATAAAACGAGGCGGGTCTGT |
| 1673 | 3756234 | TOP2A | AGAACTCGGGGAAGTGCTGGCAGTG |
| 1674 | 3756234 | TOP2A | AAGAACTCGGGGAAGTGCTGGCAGT |
| 1675 | 3756234 | TOP2A | GAACTCGGGGAAGTGCTGGCAGTGG |
| 1676 | 3756234 | TOP2A | CAAGAACTCGGGGAAGTGCTGGCAG |
| 1677 | 3756235 | TOP2A | CAGGACGGACAAATCAGCGAAAGTC |
| 1678 | 3756235 | TOP2A | CCCAGGACGGACAAATCAGCGAAAG |
| 1679 | 3756235 | TOP2A | AAGTTCACCTCGAGAGGATTGGCTG |
| 1680 | 3756235 | TOP2A | TTGGCTGCGCGCAGACACCTCTTCG |
| 1681 | 3756237 | TOP2A | AATTTATCCTTAAGTATGGTCCCTG |
| 1682 | 3756237 | TOP2A | TTATCCTTAAGTATGGTCCCTGTTT |
| 1683 | 3756237 | TOP2A | ATCCTTAAGTATGGTCCCTGTTTCG |
| 1684 | 3756237 | TOP2A | CCTTAAGTATGGTCCCTGTTTCGTC |
| 1685 | 3757155 | KRT14 | ACCGTTAGTTATGTCGAAGTAATAG |
| 1686 | 3757155 | KRT14 | ATCCTCCGGGGGCACACCTGTGTC |
| 1687 | 3757156 | KRT14 | GCGGTTTAGGCGTGGTTCCAGTACC |
| 1688 | 3757156 | KRT14 | TCGGCGGTTTAGGCGTGGTTCCAGT |
| 1689 | 3757156 | KRT14 | CGGTTTAGGCGTGGTTCCAGTACCT |

TABLE 1-continued

PORTOS Target Sequences

| SEQ ID NO. | Affy Probeset ID | Gene | Sequence |
|---|---|---|---|
| 1690 | 3757156 | KRT14 | AGGTCGGCGGTTTAGGCGTGGTTCC |
| 1691 | 3757157 | KRT14 | ACCCTCGGGAGCAGACTTTCTTTAC |
| 1692 | 3757157 | KRT14 | ACTCGAGATCACGACAGTGGGTCAA |
| 1693 | 3757157 | KRT14 | GAGAACGAAGATGCACCACAGACAC |
| 1694 | 3757157 | KRT14 | GACTCTGGTGAGGTAACCCACTTAT |
| 1695 | 3757160 | KRT14 | GACCTCCTCTGGTTTCCAGCGATGA |
| 1696 | 3757160 | KRT14 | TCTAGGTCCTCTACTAACCGTCGCA |
| 1697 | 3757160 | KRT14 | TCCTCTGGTTTCCAGCGATGACGTA |
| 1698 | 3757160 | KRT14 | CTGGTTTCCAGCGATGACGTACGTC |
| 1699 | 3757162 | KRT14 | GTTCTCGCTCTAGAGCCTCGAGGCC |
| 1700 | 3757162 | KRT14 | CGTCTTGGACCTCTAACTCGACGTC |
| 1701 | 3757162 | KRT14 | ACCGGTGGTTGTCGCTCGACCACGT |
| 1702 | 3757162 | KRT14 | CCTCGAGGCCGCGTGGTACGTCTTG |
| 1703 | 3757164 | KRT14 | CCTCTACCTGCGACGTGGACCGCAC |
| 1704 | 3757164 | KRT14 | CGGTCCACCCACCTCTACAGTTACA |
| 1705 | 3757164 | KRT14 | CTACTTACGGGACTCTCCGGTCCAC |
| 1706 | 3757164 | KRT14 | AGACTTGCTCTACGCACTGGTCATA |
| 1707 | 3757167 | KRT14 | CACAGAGTATGGAAAAGAGACCCCA |
| 1708 | 3757167 | KRT14 | CTACCCACAGAGTATGGAAAAGAGA |
| 1709 | 3757167 | KRT14 | ATGGAAAAGAGACCCCAGTAAGGTC |
| 1710 | 3757167 | KRT14 | AGTATGGAAAAGAGACCCCAGTAAG |
| 1711 | 3757169 | KRT14 | TCGGTGTCACCTGTTACGGTTACAG |
| 1712 | 3757169 | KRT14 | ACTGTTACGGGCAGACCGGCGCCTA |
| 1713 | 3757169 | KRT14 | ACCGGCGCCTACTGAAGGCGTGGTT |
| 1714 | 3757169 | KRT14 | CGGTTACAGGAAGACGTCTAACTGT |
| 1715 | 3757172 | KRT14 | ACCCCCTCCTATACCACCACCGGAA |
| 1716 | 3757172 | KRT14 | CCGAAACCACCACCGAAACGACCAC |
| 1717 | 3757172 | KRT14 | ACCGGAACCACGACCGAACCCACCA |
| 1718 | 3757172 | KRT14 | GAAACGACCACCACTACCCGAAGAC |
| 1719 | 3757174 | KRT14 | TGAGTCGGTTGACGAGCGAGCGAGT |
| 1720 | 3757174 | KRT14 | AAGAGAAGTGAGTCGGTTGACGAGC |
| 1721 | 3757174 | KRT14 | AAGTGAGTCGGTTGACGAGCGAGCG |
| 1722 | 3757174 | KRT14 | TGGGCTCGTGGAAGAGAAGTGAGTC |
| 1723 | 3757199 | KRT14 | CTCTTCCACTGGTACGTCTTGGAGT |
| 1724 | 3757199 | KRT14 | CACTGGTACGTCTTGGAGTTACTGG |
| 1725 | 3757199 | KRT14 | TTCCACTGGTACGTCTTGGAGTTAC |
| 1726 | 3757199 | KRT14 | CGTCTTGGAGTTACTGGCGGACCGG |
| 1727 | 3815758 | MUM1 | CGTCGCCAACCGCCCGCCCAGGAGG |
| 1728 | 3815758 | MUM1 | GACGCCGGAGGAACGGGCCCGAACC |
| 1729 | 3815758 | MUM1 | GCCCAGGAGGCGACAACGCCGGCGA |
| 1730 | 3815758 | MUM1 | CCGCCGCGCCTGCCGTCGCCAACCG |
| 1731 | 3815759 | MUM1 | ACTCTGGACCCTCATGCAACACGGT |
| 1732 | 3815759 | MUM1 | TGTGTAACCGCACTCTGGACCCTCA |
| 1733 | 3815759 | MUM1 | TGTAACCGCACTCTGGACCCTCATG |
| 1734 | 3815759 | MUM1 | CCTCATGCAACACGGTTTAGTAACG |
| 1735 | 3815762 | MUM1 | ACCGGGCTTGGCGCTGAAGTTGTTT |
| 1736 | 3815762 | MUM1 | ACACGTTTAGGAGAGATCTCCTT |
| 1737 | 3815762 | MUM1 | TTCCTTATAAAGATCGACACGTTT |
| 1738 | 3815762 | MUM1 | AAACCGGGCTTGGCGCTGAAGTTGT |
| 1739 | 3815763 | MUM1 | TGTCAACTTCGGGTCGGGTGAGAAT |
| 1740 | 3815763 | MUM1 | AAGGGCACATCTAAAGACTATGAAG |
| 1741 | 3815763 | MUM1 | CAAAGAATTAGTCACGGTACGGTCC |
| 1742 | 3815763 | MUM1 | GGTTTGCTCCGTAAGACACTCTAGA |
| 1743 | 3815764 | MUM1 | TTCCGTTTATTGACTACTGGTCCGC |
| 1744 | 3815764 | MUM1 | TGCAGACACTGTCCGGGTAGTTAAA |
| 1745 | 3815764 | MUM1 | TGGTCCGCCGTGTAACAAGACGAGG |
| 1746 | 3815764 | MUM1 | CGGACAGTGAGATTTGGTCGCAAAT |
| 1747 | 3815765 | MUM1 | CCACGTAGACAGCACTCTTAAGGGT |
| 1748 | 3815765 | MUM1 | CGTGGCCCTTCCACATCTAGTAGAT |
| 1749 | 3815765 | MUM1 | ACTAGGGCGCATCAGGTTCCGTAAC |
| 1750 | 3815765 | MUM1 | TCGACGGAGACTTCGAGCGAACCAG |
| 1751 | 3815766 | MUM1 | GAGTGTGAAAGGGACGCCGACCCTT |
| 1752 | 3815766 | MUM1 | AGTGTGAAAGGGACGCCGACCCTTC |
| 1753 | 3815767 | MUM1 | CATTGGAGTCCGTCTACTTAAGGAT |
| 1754 | 3815767 | MUM1 | TGGTCCCAAGAACGACGGACATTGG |
| 1755 | 3815767 | MUM1 | ACTTTTACAGAACCGCCGCAACCGA |
| 1756 | 3815767 | MUM1 | CACATTGCAGCTAAAACAGAGACGT |
| 1757 | 3815769 | MUM1 | TTGCGCTTAGGGGACTCGACTTCCT |
| 1758 | 3815769 | MUM1 | ATAAGAACTGCGGGTCTTACCAGTC |
| 1759 | 3815769 | MUM1 | CTTAAACGGGGATCTTGGTGAGGAT |
| 1760 | 3815769 | MUM1 | TGAGGATAAGAACTGCGGGTCTTAC |
| 1761 | 3815770 | MUM1 | GAGACGTATTGAATCCGCCCGACT |
| 1762 | 3815770 | MUM1 | TAGTAGAACCTACCGCAGCAGGAAC |
| 1763 | 3815770 | MUM1 | CCGTGGGTAACAAACTCCGTGACAG |

TABLE 1-continued

PORTOS Target Sequences

| SEQ ID NO. | Affy Probeset ID | Gene | Sequence |
|---|---|---|---|
| 1764 | 3815770 | MUM1 | CGTAATACGGGCGACTCAACACTAT |
| 1765 | 3815771 | MUM1 | TGTCTGCCAGCGAAGCGCACCGAGA |
| 1766 | 3815771 | MUM1 | CCAAGGACGCCGTGGGGACCTTCTT |
| 1767 | 3815771 | MUM1 | CTTGACCGGATGTCTGCCAGCGAAG |
| 1768 | 3815771 | MUM1 | GAGACCTGCAAGACTCGCTCCCGAG |
| 1769 | 3815772 | MUM1 | CGGTACACACGTTGTTTCGGACAGT |
| 1770 | 3815772 | MUM1 | GGTCTACAGAAGGAACGGGCCTAAG |
| 1771 | 3815772 | MUM1 | CAACCCGTCAAGGTCTGGAGTGTCC |
| 1772 | 3815772 | MUM1 | CTCGTACAGAGGAGCGGGACACTAA |
| 1773 | 3815773 | MUM1 | TCTCAGGTACCCCAGATTAAGGTAC |
| 1774 | 3815773 | MUM1 | CCTTCTGCTCCTCGGTGGTTCTCAG |
| 1775 | 3815773 | MUM1 | ACGGTCAGAAGGCTTCTCAGGTACC |
| 1776 | 3815773 | MUM1 | CCCCAGATTAAGGTACGCAAGATAG |
| 1777 | 3815774 | MUM1 | CCTTACGATCAGACCGTATTTGTAT |
| 1778 | 3815774 | MUM1 | ACTTCATCCTTACGATCAGACCGTA |
| 1779 | 3815774 | MUM1 | CATCCTTACGATCAGACCGTATTTG |
| 1780 | 3815774 | MUM1 | ATCCTTACGATCAGACCGTATTTGT |
| 1781 | 3815775 | MUM1 | TTTCGCAGTCCGTCTCTCTATTCTT |
| 1782 | 3815775 | MUM1 | CAGTTTTCGCAGTCCGTCTCTCTAT |
| 1783 | 3815775 | MUM1 | TCGTTCACACGATATGTAGCTTCCT |
| 1784 | 3815775 | MUM1 | TCCTGTGTACTTGGGCTTTTACTTT |
| 1785 | 3815778 | MUM1 | CCGACCACACAGAGGGAGTAGTGGC |
| 1786 | 3815778 | MUM1 | TTCGGTCCCTCCTGAAGTTGGTCCT |
| 1787 | 3815778 | MUM1 | GTAGTGGCTGATGTCCCAGGCCAAT |
| 1788 | 3815778 | MUM1 | CCTGAAGTTGGTCCTGTAGCCGACC |
| 1789 | 3815780 | MUM1 | GGCTTTTAGGTAGGTCGTCCTGCAG |
| 1790 | 3815780 | MUM1 | AACCCCTGGTTCGAAGGAGTTGACT |
| 1791 | 3815780 | MUM1 | CGAAGGAGTTGACTCGTTCCCCTCG |
| 1792 | 3815780 | MUM1 | GAACCCCTGGTTCGAAGGAGTTGAC |
| 1793 | 3815781 | MUM1 | GTGGACGCCCGGTAGGATTTCTCGT |
| 1794 | 3815781 | MUM1 | ACTTCATGGACGTCCCGCAGATGGT |
| 1795 | 3815781 | MUM1 | AGTAAGACCTGCACGAAGACGGGCT |
| 1796 | 3815781 | MUM1 | ACTCGAGGTCGGTCATGCACTGGAC |
| 1797 | 3815783 | MUM1 | ACGAACAGTGTCGATTCCCACGAAG |
| 1798 | 3815783 | MUM1 | CTCTGAGACGAGACTTGGCTTACCT |
| 1799 | 3815783 | MUM1 | AAGAATTGGCGTCCGGTGAACCCCG |
| 1800 | 3815783 | MUM1 | GTCCCTAAGTACCTGATCCAAACGT |
| 1801 | 3815784 | MUM1 | ACCTGCTCCACCTGATGTTCTGCCG |
| 1802 | 3815784 | MUM1 | GTAGTTCCCCGGAAGCGACTCGATG |
| 1803 | 3815784 | MUM1 | TTCTGCCGACTCCTCTTCATGTAGT |
| 1804 | 3815784 | MUM1 | CGGTAGTAGACACGCTAGAGACGCC |
| 1805 | 3815786 | MUM1 | CCGGGTCGACCGAATGGTTTTGTCC |
| 1806 | 3815786 | MUM1 | CTCGCGGATTAGGACAGAGACCCGT |
| 1807 | 3815786 | MUM1 | AAAGGACGACCTAGAAGTACCAAGG |
| 1808 | 3815786 | MUM1 | TGTAGGCACACGAATCGACGGGAAC |
| 1809 | 3815787 | MUM1 | GGGCAATCCTCAAGTAGTGTCGAAG |
| 1810 | 3815787 | MUM1 | AACGGCTGTAGTTTTGGGCAATCCT |
| 1811 | 3815787 | MUM1 | GCGGCCCTGTACGAGTTTTATTGT |
| 1812 | 3815787 | MUM1 | GGTCAACGGTACTTTCGGAGGGCAC |
| 1813 | 3815790 | MUM1 | CTTTATAAACTGTTGGTCGAGGAAC |
| 1814 | 3815790 | MUM1 | TCTTTATAAACTGTTGGTCGAGGAA |
| 1815 | 3815790 | MUM1 | CGAGGAACTTCTCGCCTTGGCGCG |
| 1816 | 3815790 | MUM1 | AACTTCTCGCCTTGGCCGCGGCAGC |
| 1817 | 3815791 | MUM1 | GACCGCCACCTTCGCGGAGGTCACA |
| 1818 | 3815791 | MUM1 | GGACCGCCACCTTCGCGGAGGTCAC |
| 1819 | 3815791 | MUM1 | CGGACCGCCACCTTCGCGGAGGTCA |
| 1820 | 3815791 | MUM1 | CCGCCACCTTCGCGGAGGTCACACG |
| 1821 | 3815792 | MUM1 | CCTCTTAGGTAAAGCAATTGTGACT |
| 1822 | 3815792 | MUM1 | CGACACCAAAGAGGGCTGCACGTGT |
| 1823 | 3815792 | MUM1 | CTTCGCATAAGTGACACGCGGTCAT |
| 1824 | 3815792 | MUM1 | CTAGAGCATACACACCGTAGACTAT |
| 1825 | 3815793 | MUM1 | GGCGGACGCTGTCAAGGTCTTAAAC |
| 1826 | 3815793 | MUM1 | TCTTAAACGAGAGGGTGAGTCACAC |
| 1827 | 3815793 | MUM1 | TCAGTGGCGCCAGAGTCAGTAGCCG |
| 1828 | 3815793 | MUM1 | GCGTCGGAAACATACCTCCGGGTTG |
| 1829 | 3815794 | MUM1 | AAACTCCCCGACACTGGGAGAAGGG |
| 1830 | 3815794 | MUM1 | TACAGGTCCCAAGGTCCCGGGCCAC |
| 1831 | 3815794 | MUM1 | ACGAAACTCCCCGACACTGGGAGAA |
| 1832 | 3815794 | MUM1 | CGGAACGAAACTCCCCGACACTGGG |
| 1833 | 3815795 | MUM1 | GTCGGCTGCTGTCGGTGGCCTCTCC |
| 1834 | 3815795 | MUM1 | CTCCTCTAGCCTTGTGCTAACAGAG |
| 1835 | 3815795 | MUM1 | TTCCTGAGAGCATAGCCCGGGAACC |
| 1836 | 3815795 | MUM1 | CCTGCTTCGGCGTTCCTGAGAGCAT |
| 1837 | 3815796 | MUM1 | GTCCTTTGGGCCGGCACCGGACCGT |

TABLE 1-continued

PORTOS Target Sequences

| SEQ ID NO. | Affy Probeset ID | Gene | Sequence |
|---|---|---|---|
| 1838 | 3815796 | MUM1 | ACTGGAAACAAAGTGAACGGAGACG |
| 1839 | 3815796 | MUM1 | GAGCTGAGGCTCTCGTCCTTTGGGC |
| 1840 | 3815796 | MUM1 | TGAACGGAGACGAGCTGAGGCTCTC |
| 1841 | 3815797 | MUM1 | CGCCCCGAGTCGTCGCAACGTACAT |
| 1842 | 3815797 | MUM1 | GCCGGTCATGGTGGCGGACTCCGCC |
| 1843 | 3815797 | MUM1 | GGGACGACCAGCGACAAAGCCCCTG |
| 1844 | 3815797 | MUM1 | CCTCGTCACCCCGTGTGGGGCCTCC |
| 1845 | 3815798 | MUM1 | AGTACCTTTTAGGAGGCCTCGGCGG |
| 1846 | 3815798 | MUM1 | GCCCGGAGCATGACGGAGTACCTTT |
| 1847 | 3815798 | MUM1 | ACGGAGTACCTTTTAGGAGGCCTCG |
| 1848 | 3815798 | MUM1 | AGCATGACGGAGTACCTTTTAGGAG |
| 1849 | 3815799 | MUM1 | GGAACGGTTCAACAAGCTCCACCTT |
| 1850 | 3815799 | MUM1 | CTCCACCTTAATTTGTGGAGGGTCT |
| 1851 | 3815799 | MUM1 | CTCATCCTGTGTAACGGTACCAAAA |
| 1852 | 3815799 | MUM1 | GACGACAACACTTCATGAAAATAGG |
| 1853 | 3908359 | SULF2 | TAAGCGGAACCGGTTGGGAAGAAAC |
| 1854 | 3908359 | SULF2 | GATCGTTGAGGGATCACCGCAAAAA |
| 1855 | 3908359 | SULF2 | AAATTGTCTACTGCCTCTATTAGGG |
| 1856 | 3908359 | SULF2 | GGGAAGAAACACATAGTCCATCAGA |
| 1857 | 3908360 | SULF2 | CCTCATCTACCAACATCTAACTGAT |
| 1858 | 3908360 | SULF2 | TATGATGGTCAGTTGTAGAAAAACC |
| 1859 | 3908360 | SULF2 | AGATGGTATGAAGTTCCCTGATGTC |
| 1860 | 3908360 | SULF2 | TAAGTTCTATGATGGTCAGTTGTAG |
| 1861 | 3908361 | SULF2 | CGGTTACTGGTCGTCAACCATACTT |
| 1862 | 3908361 | SULF2 | AGAAACAATACAGGGTCTTGACTAC |
| 1863 | 3908361 | SULF2 | AGGGAGCGTCAACACCTGTAAAGAC |
| 1864 | 3908361 | SULF2 | ACAGGTCTATGGTAAAGAGGATCAT |
| 1865 | 3908362 | SULF2 | AAACCTAATATGGAGTGGTCGACGT |
| 1866 | 3908362 | SULF2 | AGAGGGTTCCCGCTTTCAGTAACCT |
| 1867 | 3908362 | SULF2 | TCGTCAGGACAAGATTTAGGAGAAT |
| 1868 | 3908362 | SULF2 | ACCACAGTTATTTGCGAGACACCGG |
| 1869 | 3908364 | SULF2 | TCAAAGTCGCAGCTTTCACCGGTCT |
| 1870 | 3908364 | SULF2 | CAAAGTCGCAGCTTTCACCGGTCTT |
| 1871 | 3908364 | SULF2 | CGTCAAAGTCGCAGCTTTCACCGGT |
| 1872 | 3908364 | SULF2 | AAAGTCGCAGCTTTCACCGGTCTTT |
| 1873 | 3908365 | SULF2 | GACGTGGACAATAGAACTCTTTGAC |
| 1874 | 3908365 | SULF2 | TCAGAGTAGAGACACTCAGACGTGG |
| 1875 | 3908365 | SULF2 | GTCCTAGTGGGTGGTTTCTATCCAC |
| 1876 | 3908365 | SULF2 | CCACAGTGGATCCTCTGGAAGAAAC |
| 1877 | 3908366 | SULF2 | TACCTCCTTCGATACTCGTTATGTC |
| 1878 | 3908368 | SULF2 | GGACTTTGGTACAACTGATTTCTAC |
| 1879 | 3908368 | SULF2 | ACGGGTCCTTTGTGTGCCTTAAGGC |
| 1880 | 3908368 | SULF2 | GCCTTAAGGCAGAGTAAAGTAACAG |
| 1881 | 3908368 | SULF2 | CTCTCTCCTTGTGGACGTGGTTGAC |
| 1882 | 3908369 | SULF2 | CTACAGGAGTTGGTCGATGTGCATG |
| 1883 | 3908369 | SULF2 | GTTGGTCGATGTGCATGTCGAGTAC |
| 1884 | 3908369 | SULF2 | GGGGCCTGAGCTTTGTACCTGGACC |
| 1885 | 3908369 | SULF2 | GGTCGATGTGCATGTCGAGTACCTC |
| 1886 | 3908371 | SULF2 | ATCTCATGAAACTAGAGTTGTGTCT |
| 1887 | 3908371 | SULF2 | GGTCGCGGTTGTTATTGTGCATGAC |
| 1888 | 3908371 | SULF2 | ACGTACTCCTGGTAGTTACTCTGAG |
| 1889 | 3908371 | SULF2 | CACTTAAACGTTGACCGAAGGATCT |
| 1890 | 3908373 | SULF2 | GTCCGGAGTGCACGAAGTGGGTGCT |
| 1891 | 3908373 | SULF2 | AGTGCACGAAGTGGGTGCTGTTGGT |
| 1892 | 3908373 | SULF2 | ACCGTCTGCCGCGGAAAGACCTGTG |
| 1893 | 3908373 | SULF2 | TGCTGTTGGTCGTGACCGTCTGCCG |
| 1894 | 3908374 | SULF2 | AGTTCGCGGACGTCTTGTTGCTGTG |
| 1895 | 3908374 | SULF2 | ACGAGTTCGCGGACGTCTTGTTGCT |
| 1896 | 3908374 | SULF2 | GACGAGTTCGCGGACGTCTTGTTGC |
| 1897 | 3908374 | SULF2 | GGACGTCTTGTTGCTGTGCACGTCG |
| 1898 | 3908375 | SULF2 | ACCGACAACGCCCTCGTCTTCGCGT |
| 1899 | 3908375 | SULF2 | ACAACGCCCTCGTCTTCGCGTTCTT |
| 1900 | 3908375 | SULF2 | GACAACGCCCTCGTCTTCGCGTTCT |
| 1901 | 3908375 | SULF2 | CCACACCGACAACGCCCTCGTCTTC |
| 1902 | 3908377 | SULF2 | TCTCCGAGGTCAGACGTAGGAAAGT |
| 1903 | 3908377 | SULF2 | GTGTTTCCGGCGGAGTTCGTGTCTC |
| 1904 | 3908377 | SULF2 | CTCCGAGGTCAGACGTAGGAAAGTC |
| 1905 | 3908377 | SULF2 | TGTTTCCGGCGGAGTTCGTGTCTCC |
| 1906 | 3908381 | SULF2 | CTTTTTCGCCGGTCTTCTTACACTG |
| 1907 | 3908381 | SULF2 | TCGCCGGTCTTCTTACACTGACAGT |
| 1908 | 3908381 | SULF2 | TTCGCCGGTCTTCTTACACTGACAG |
| 1909 | 3908381 | SULF2 | CCGGTCTTCTTACACTGACAGTGTT |
| 1910 | 3908382 | SULF2 | GTCTTGTTTAATTCTTGGACTCCC |
| 1911 | 3908382 | SULF2 | TAATTCTTGGACTCCCTTCAGGCTC |

TABLE 1-continued

PORTOS Target Sequences

| SEQ ID NO. | Affy Probeset ID | Gene | Sequence |
|---|---|---|---|
| 1912 | 3908382 | SULF2 | GACGTCTTGTTTTAATTCTTGGACT |
| 1913 | 3908382 | SULF2 | GGGACGTCTTGTTTTAATTCTTGGA |
| 1914 | 3908388 | SULF2 | GACCTGGACATGTTCAGGGACGTCC |
| 1915 | 3908388 | SULF2 | GGATCTCTTGCTGTGTCAGGTCACA |
| 1916 | 3908388 | SULF2 | GGTCACACTGGACCTGGACATGTTC |
| 1917 | 3908388 | SULF2 | AGGATCTCTTGCTGTGTCAGGTCAC |
| 1918 | 3908390 | SULF2 | GTCAGCGAGGTAGGCGAGTCACCGG |
| 1919 | 3908390 | SULF2 | TGTTCCGGTCGATACAGGCGTCAGC |
| 1920 | 3908390 | SULF2 | GCTTTGGAGTGGTTCGCCGTGACCG |
| 1921 | 3908390 | SULF2 | TGCCGTCCCACATGGTGCATCCGGA |
| 1922 | 3908391 | SULF2 | GCCCCTGATGTTCGAGTCGGACCGG |
| 1923 | 3908391 | SULF2 | GACGTGGACACTGTCGCCCCTGATG |
| 1924 | 3908391 | SULF2 | GTTGGAGCACGGGTTCATGATGCCC |
| 1925 | 3908391 | SULF2 | TCGACTTCGACGTATTCACGTTCCC |
| 1926 | 3908393 | SULF2 | GACTCATGGTCTGCCGCACACTCGT |
| 1927 | 3908393 | SULF2 | TGGACACAGTCGCACGACTCATGGT |
| 1928 | 3908393 | SULF2 | TGGTCGCACACTTCCTGGACACAGT |
| 1929 | 3908393 | SULF2 | CTGCGGGTCCTCCTCTTGAAAGACG |
| 1930 | 3908394 | SULF2 | TCCCAGACCGCCCTGAGGAAGAACC |
| 1931 | 3908394 | SULF2 | TTCTACTCCCAGACCGCCCTGAGGA |
| 1932 | 3908394 | SULF2 | TACTCCCAGACCGCCCTGAGGAAGA |
| 1933 | 3908394 | SULF2 | ACTCCCAGACCGCCCTGAGGAAGAA |
| 1934 | 3908395 | SULF2 | CCTGCCCTTTAGGTAGGAGTTCGAC |
| 1935 | 3908395 | SULF2 | TGTAGCAGGAGTTGTAACTGGACCG |
| 1936 | 3908395 | SULF2 | ATGGACGCCTATACCTGCCCTTTAG |
| 1937 | 3908395 | SULF2 | CTGTAACGTCCGGACCTGTATGGAC |
| 1938 | 3908397 | SULF2 | ACTCAAACTGTAGTCCCAGGGCAAG |
| 1939 | 3908397 | SULF2 | TGTGCATGTAGCATATGTGGCGGCT |
| 1940 | 3908397 | SULF2 | GTGCCAATGGTGTAGCCGGTCAAAC |
| 1941 | 3908397 | SULF2 | GCCCGCTCGACCTGTTGTGCATGTA |
| 1942 | 3908400 | SULF2 | ACAGCCACCTGCTGAGGTACCTCTG |
| 1943 | 3908400 | SULF2 | GGTTGTACGAGGTCGCCTTCGCGAA |
| 1944 | 3908400 | SULF2 | CTTCGCGAACGTCTGGGAGTACAGC |
| 1945 | 3908400 | SULF2 | TTGTGACCTAGTACGCGATGTGCCC |
| 1946 | 3908401 | SULF2 | TGCAGGTTCTTCTACATGGGCGTGT |
| 1947 | 3908401 | SULF2 | TCTGGAGTAGTGGTTACTGTCGCAC |
| 1948 | 3908401 | SULF2 | AGGAGTACCAGTAGTCGGTACGTCG |
| 1949 | 3908401 | SULF2 | ACTGTCGCACTCGAAGAAGGCGTGC |
| 1950 | 3908407 | SULF2 | ACCTGGATTGGTCCGGGAGGTAAAC |
| 1951 | 3908407 | SULF2 | GTGACGTGAGACTACTTAGACCACT |
| 1952 | 3908407 | SULF2 | CACACTGTCTGAAGGGTGACTACGT |
| 1953 | 3908407 | SULF2 | CCGAAGGACTGATTTGAGGTCTCAC |
| 1954 | 3908417 | SULF2 | CCGTGTCGTGCTCTCGGCGTGGAAA |
| 1955 | 3908417 | SULF2 | CGCGTGAAGTAGTTGCGGAAGCACT |
| 1956 | 3908417 | SULF2 | CCACTACTTGTTCTGGGCCGCGTAG |
| 1957 | 3908417 | SULF2 | GCGTGGAAACGGCACATGGAGTTAT |
| 1958 | 3908426 | SULF2 | TTCGAGCCGGAAGGACAGCGTGGTG |
| 1959 | 3908426 | SULF2 | AGCGTGGTGGCGGACTTTCCGTCCA |
| 1960 | 3908426 | SULF2 | AACGACAGGCGTTGACACAAGAGGG |
| 1961 | 3908426 | SULF2 | GTCCAAAGTCTCCCTGGCGTCCTTG |
| 1962 | 3908435 | SULF2 | CGCCTCAGGGGACGCGGGTCGCCGG |
| 1963 | 3908435 | SULF2 | CAGGGGACGCGGGTCGCCGGGCCGG |
| 1964 | 3908435 | SULF2 | GGGGACGCGGGTCGCCGGGCCGGCC |
| 1965 | 3908435 | SULF2 | CTCAGGGGACGCGGGTCGCCGGGCC |
| 1966 | 3908436 | SULF2 | GCCTCCGTAGCCCTCCAGCTCTCGG |
| 1967 | 3908436 | SULF2 | GCGCCGGTCGGCTCAGGCCTCCGTA |
| 1968 | 3908436 | SULF2 | CAAGTGACGGGGCAGGCCTCGACCT |
| 1969 | 3908436 | SULF2 | ACACGCAGACACAGGGCCGCTCC |
| 1970 | 3908437 | SULF2 | TGTGCACGTGTGTTCCGAGACCGAG |
| 1971 | 3908437 | SULF2 | CTACCGGGAGGACTTAAATAGTGCT |
| 1972 | 3908437 | SULF2 | CTAAGTGCAGCAAAGGTCGGTTCAC |
| 1973 | 3908437 | SULF2 | CCGCGGCCGGAGAGGTTACCGTTTA |
| 1974 | 3978625 | APEX2 | CGACCCTCCACAAGGTCGGGAAATT |
| 1975 | 3978625 | APEX2 | CCGCGCCCGACCCTCCACAAGGTCG |
| 1976 | 3978625 | APEX2 | GACCCTCCACAAGGTCGGGAAATTC |
| 1977 | 3978625 | APEX2 | CAACCGCGCCCGACCCTCCACAAGG |
| 1978 | 3978626 | APEX2 | CGACCTACGCCTATAGCAGACAGAG |
| 1979 | 3978626 | APEX2 | TCGACCTTGTAGTTACCCTAAGCCT |
| 1980 | 3978626 | APEX2 | CCGCGTAAACCTGCTCGACCTACG |
| 1981 | 3978626 | APEX2 | TAGTCCTTGGGTCGTTGACACGGCG |
| 1982 | 3978629 | APEX2 | GACATTCCTGTTACGATGGGGTCAC |
| 1983 | 3978629 | APEX2 | TCCTTGAGGCCCGAGACCTATCACT |
| 1984 | 3978629 | APEX2 | ATACCTTTGTACCTACTCAAATGGG |
| 1985 | 3978629 | APEX2 | CCGGACTCACCGGACAAACGGTGGG |

TABLE 1-continued

PORTOS Target Sequences

| SEQ ID NO. | Affy Probeset ID | Gene | Sequence |
|---|---|---|---|
| 1986 | 3978630 | APEX2 | CGCGAAGATAGCAAACGACGTTTAG |
| 1987 | 3978630 | APEX2 | ATTCCTCTTCTGGAACTGGGATTAG |
| 1988 | 3978630 | APEX2 | GGACTCGCCGATCAGAAATTCTACG |
| 1989 | 3978630 | APEX2 | CGTTTAGGCTCGTCTTCGGGAGGAC |
| 1990 | 3978634 | APEX2 | ACCTACCTGTCGAACGAGTCATTGA |
| 1991 | 3978634 | APEX2 | ACGGAGAGTACATCCCGGGAAGTAG |
| 1992 | 3978634 | APEX2 | TATCGATGGCGACGAAGGTTGGTTT |
| 1993 | 3978634 | APEX2 | ACGAGTCATTGAACCCCACGGTCAG |
| 1994 | 3978635 | APEX2 | GAGACACGGACGTTTTGTCACGGGT |
| 1995 | 3978635 | APEX2 | CCCCTGTCCTGGGACCAGTATCTGT |
| 1996 | 3978635 | APEX2 | GTAGAGTTGATACCGAGGGCCGAAC |
| 1997 | 3978635 | APEX2 | TCCGTGGGTCGAGTTCTAGGAAGCG |
| 1998 | 3978636 | APEX2 | CTCGACGGATCGGATGGTGACTACT |
| 1999 | 3978636 | APEX2 | AGTTTGGGCCCATGTCTGTACGGTT |
| 2000 | 3978636 | APEX2 | GTTTCAGGACACAACCTCGTCAGCT |
| 2001 | 3978636 | APEX2 | CGGGTCAGTCCAACCGAGATCGTCT |
| 2002 | 3978637 | APEX2 | ACTCTTCCTCAATGCCTGGAGTAAG |
| 2003 | 3978637 | APEX2 | ACTTCTTCGGTCCTGGGTTGAACCC |
| 2004 | 3978637 | APEX2 | CTCGGTACACACTACGCATGACACT |
| 2005 | 3978637 | APEX2 | GAACCCGGCGGCGAAGATGTACACA |
| 2006 | 3978638 | APEX2 | AGGAACAACCACTCGAAGAACACGG |
| 2007 | 3978638 | APEX2 | AACACGGAATTAGGACACTGGGTCG |
| 2008 | 3978638 | APEX2 | GGCTTCATGTGCCTGTGATCGACGG |
| 2009 | 3978638 | APEX2 | GGACGTGTACTAGACTCCGGTCGAG |
| 2010 | 3978639 | APEX2 | ATGAGGTATTTCAACTCAGTCTCTT |
| 2011 | 3978639 | APEX2 | ACCTCCATGAGGTATTTCAACTCAG |
| 2012 | 3978639 | APEX2 | ACCTGTAACACCTCCATGAGGTATT |
| 2013 | 3978639 | APEX2 | GTGAAACCTGTAACACCTCCATGAG |
| 2014 | 3978641 | APEX2 | GACACTGGACCTTTCACCCTCGTAA |
| 2015 | 3978641 | APEX2 | AACTTTTACCCTGACCATCTGGTCC |
| 2016 | 3978641 | APEX2 | ACCCTCGTAACGAAACTTGTGTCAC |
| 2017 | 3978641 | APEX2 | TGTGTCACGAACGAGATCGGTTCGG |
| 2018 | 3978642 | APEX2 | GTGACACATCAAAAACCCGTAAAGG |
| 2019 | 3978642 | APEX2 | GATCGAGAAACGTTGAGTGACACAT |
| 2020 | 3978642 | APEX2 | GTCACTTCGCAGTTAGGGACCTAAA |
| 2021 | 3978642 | APEX2 | CGTGAACAGACAAGGGACAGGTTAT |

Probes/Primers

The present invention provides for a probe set for predicting response of a subject to post-operative radiation therapy for prostate cancer comprising a plurality of probes, wherein (i) the probes in the set are capable of detecting an expression level of at least one target selected from Table 1 or Table 2; and (ii) the expression level determines whether or not the subject will benefit from post-operative radiation therapy with at least about 40% specificity.

The probe set may comprise one or more polynucleotide probes. Individual polynucleotide probes comprise a nucleotide sequence derived from the nucleotide sequence of the target sequences or complementary sequences thereof. The nucleotide sequence of the polynucleotide probe is designed such that it corresponds to, or is complementary to the target sequences. The polynucleotide probe can specifically hybridize under either stringent or lowered stringency hybridization conditions to a region of the target sequences, to the complement thereof, or to a nucleic acid sequence (such as a cDNA) derived therefrom.

The selection of the polynucleotide probe sequences and determination of their uniqueness may be carried out in silico using techniques known in the art, for example, based on a BLASTN search of the polynucleotide sequence in question against gene sequence databases, such as the Human Genome Sequence, UniGene, dbEST or the non-redundant database at NCBI. In one embodiment of the invention, the polynucleotide probe is complementary to a region of a target mRNA derived from a target sequence in the probe set. Computer programs can also be employed to select probe sequences that may not cross hybridize or may not hybridize non-specifically.

In some instances, microarray hybridization of RNA, extracted from prostate cancer tissue samples and amplified, may yield a dataset that is then summarized and normalized by the fRMA technique. After removal (or filtration) of cross-hybridizing PSRs, and PSRs containing less than 4 probes, the remaining PSRs can be used in further analysis. Following fRMA and filtration, the data can be decomposed into its principal components and an analysis of variance model is used to determine the extent to which a batch effect remains present in the first 10 principal components.

These remaining PSRs can then be subjected to filtration by a T-test between CR (clinical recurrence) and non-CR samples. Using a p-value cut-off of 0.01, the remaining features (e.g., PSRs) can be further refined. Feature selection can be performed by regularized logistic regression using the elastic-net penalty. The regularized regression may be bootstrapped over 1000 times using all training data; with each iteration of bootstrapping, features that have non-zero co-efficient following 3-fold cross validation can be tabulated. In some instances, features that were selected in at least 25% of the total runs were used for model building.

The polynucleotide probes of the present invention may range in length from about 15 nucleotides to the full length of the coding target or non-coding target. In one embodiment of the invention, the polynucleotide probes are at least about 15 nucleotides in length. In another embodiment, the polynucleotide probes are at least about 20 nucleotides in length. In a further embodiment, the polynucleotide probes are at least about 25 nucleotides in length. In another embodiment, the polynucleotide probes are between about 15 nucleotides and about 500 nucleotides in length. In other embodiments, the polynucleotide probes are between about 15 nucleotides and about 450 nucleotides, about 15 nucleotides and about 400 nucleotides, about 15 nucleotides and about 350 nucleotides, about 15 nucleotides and about 300 nucleotides, about 15 nucleotides and about 250 nucleotides, about 15 nucleotides and about 200 nucleotides in length. In some embodiments, the probes are at least 15 nucleotides in length. In some embodiments, the probes are at least 15 nucleotides in length. In some embodiments, the probes are at least 20 nucleotides, at least 25 nucleotides, at least 50 nucleotides, at least 75 nucleotides, at least 100 nucleotides, at least 125 nucleotides, at least 150 nucleotides, at least 200 nucleotides, at least 225 nucleotides, at least 250 nucleotides, at least 275 nucleotides, at least 300 nucleotides, at least 325 nucleotides, at least 350 nucleotides, at least 375 nucleotides in length.

The polynucleotide probes of a probe set can comprise RNA, DNA, RNA or DNA mimetics, or combinations thereof, and can be single-stranded or double-stranded. Thus the polynucleotide probes can be composed of naturally-occurring nucleobases, sugars and covalent internucleoside (backbone) linkages as well as polynucleotide probes having non-naturally-occurring portions which function similarly. Such modified or substituted polynucleotide probes may provide desirable properties such as, for example, enhanced affinity for a target gene and increased stability. The probe set may comprise a coding target and/or a non-coding target. Preferably, the probe set comprises a combination of a coding target and non-coding target.

In some embodiments, the probe set comprise a plurality of target sequences that hybridize to at least about 5 coding targets and/or non-coding targets selected from Table 1 or Table 2. Alternatively, the probe set comprise a plurality of target sequences that hybridize to at least about 10 coding targets and/or non-coding targets selected from Table 1 or Table 2. In some embodiments, the probe set comprise a plurality of target sequences that hybridize to at least about 15 coding targets and/or non-coding targets selected from Table 1 or Table 2. In some embodiments, the probe set comprise a plurality of target sequences that hybridize to at least about 20 coding targets and/or non-coding targets selected from Table 1 or Table 2. In some embodiments, the probe set comprise a plurality of target sequences that hybridize to at least about 24 coding targets and/or non-coding targets selected from Table 1 or Table 2.

The system of the present invention further provides for primers and primer pairs capable of amplifying target sequences defined by the probe set, or fragments or subsequences or complements thereof. The nucleotide sequences of the probe set may be provided in computer-readable media for in silico applications and as a basis for the design of appropriate primers for amplification of one or more target sequences of the probe set.

Primers based on the nucleotide sequences of target sequences can be designed for use in amplification of the target sequences. For use in amplification reactions such as PCR, a pair of primers can be used. The exact composition of the primer sequences is not critical to the invention, but for most applications the primers may hybridize to specific sequences of the probe set under stringent conditions, particularly under conditions of high stringency, as known in the art. The pairs of primers are usually chosen so as to generate an amplification product of at least about 50 nucleotides, more usually at least about 100 nucleotides. Algorithms for the selection of primer sequences are generally known, and are available in commercial software packages. These primers may be used in standard quantitative or qualitative PCR-based assays to assess transcript expression levels of RNAs defined by the probe set. Alternatively, these primers may be used in combination with probes, such as molecular beacons in amplifications using real-time PCR.

In one embodiment, the primers or primer pairs, when used in an amplification reaction, specifically amplify at least a portion of a nucleic acid sequence of a target selected from Table 2 (or subgroups thereof as set forth herein), an RNA form thereof, or a complement to either thereof.

A label can optionally be attached to or incorporated into a probe or primer polynucleotide to allow detection and/or quantitation of a target polynucleotide representing the target sequence of interest. The target polynucleotide may be the expressed target sequence RNA itself, a cDNA copy thereof, or an amplification product derived therefrom, and may be the positive or negative strand, so long as it can be specifically detected in the assay being used. Similarly, an antibody may be labeled.

In certain multiplex formats, labels used for detecting different targets may be distinguishable. The label can be attached directly (e.g., via covalent linkage) or indirectly, e.g., via a bridging molecule or series of molecules (e.g., a molecule or complex that can bind to an assay component, or via members of a binding pair that can be incorporated into assay components, e.g. biotin-avidin or streptavidin). Many labels are commercially available in activated forms which can readily be used for such conjugation (for example through amine acylation), or labels may be attached through known or determinable conjugation schemes, many of which are known in the art.

Labels useful in the invention described herein include any substance which can be detected when bound to or incorporated into the biomolecule of interest. Any effective detection method can be used, including optical, spectroscopic, electrical, piezoelectrical, magnetic, Raman scattering, surface plasmon resonance, colorimetric, calorimetric, etc. A label is typically selected from a chromophore, a lumiphore, a fluorophore, one member of a quenching system, a chromogen, a hapten, an antigen, a magnetic particle, a material exhibiting nonlinear optics, a semiconductor nanocrystal, a metal nanoparticle, an enzyme, an antibody or binding portion or equivalent thereof, an aptamer, and one member of a binding pair, and combinations thereof. Quenching schemes may be used, wherein a quencher and a fluorophore as members of a quenching pair may be used on a probe, such that a change in optical parameters occurs upon binding to the target introduce or quench the signal from the fluorophore. One example of such a system is a molecular beacon. Suitable quencher/fluorophore systems are known in the art. The label may be bound through a variety of intermediate linkages. For example, a polynucleotide may comprise a biotin-binding species, and an optically detectable label may be conjugated to biotin and then bound to the labeled polynucleotide. Similarly, a polynucleotide sensor may comprise an immunological species such as an antibody or fragment, and a secondary antibody containing an optically detectable label may be added.

Chromophores useful in the methods described herein include any substance which can absorb energy and emit light. For multiplexed assays, a plurality of different signaling chromophores can be used with detectably different emission spectra. The chromophore can be a lumophore or a fluorophore. Typical fluorophores include fluorescent dyes, semiconductor nanocrystals, lanthanide chelates, polynucleotide-specific dyes and green fluorescent protein.

In some embodiments, polynucleotides of the invention comprise at least 20 consecutive bases of the nucleic acid sequence of a target selected from Table 1 or Table 2 or a complement thereto. The polynucleotides may comprise at least 21, 22, 23, 24, 25, 27, 30, 32, 35, 40, 45, 50, or more consecutive bases of the nucleic acids sequence of a target selected from Table 1 or Table 2, as applicable.

The polynucleotides may be provided in a variety of formats, including as solids, in solution, or in an array. The polynucleotides may optionally comprise one or more labels, which may be chemically and/or enzymatically incorporated into the polynucleotide.

In some embodiments, one or more polynucleotides provided herein can be provided on a substrate. The substrate can comprise a wide range of material, either biological, nonbiological, organic, inorganic, or a combination of any of these. For example, the substrate may be a polymerized Langmuir Blodgett film, functionalized glass, Si, Ge, GaAs, GaP, $SiO_2$, $SiN_4$, modified silicon, or any one of a wide variety of gels or polymers such as (poly)tetrafluoroethylene, (poly)vinylidenedifluoride, polystyrene, cross-linked polystyrene, polyacrylic, polylactic acid, polyglycolic acid, poly(lactide coglycolide), polyanhydrides, poly(methyl methacrylate), poly(ethylene-co-vinyl acetate), polysiloxanes, polymeric silica, latexes, dextran polymers, epoxies, polycarbonates, or combinations thereof. Conducting polymers and photoconductive materials can be used.

The substrate can take the form of an array, a photodiode, an optoelectronic sensor such as an optoelectronic semiconductor chip or optoelectronic thin-film semiconductor, or a biochip. The location(s) of probe(s) on the substrate can be addressable; this can be done in highly dense formats, and the location(s) can be microaddressable or nanoaddressable.

Diagnostic Samples

A biological sample containing prostate cancer cells is collected from a subject in need of treatment for prostate cancer to evaluate whether a patient will benefit from radiation therapy. Diagnostic samples for use with the systems and in the methods of the present invention comprise nucleic acids suitable for providing RNAs expression information. In principle, the biological sample from which the expressed RNA is obtained and analyzed for target sequence expression can be any material suspected of comprising cancerous tissue or cells. The diagnostic sample can be a biological sample used directly in a method of the invention. Alternatively, the diagnostic sample can be a sample prepared from a biological sample.

In one embodiment, the sample or portion of the sample comprising or suspected of comprising cancerous tissue or cells can be any source of biological material, including cells, tissue or fluid, including bodily fluids. Non-limiting examples of the source of the sample include an aspirate, a needle biopsy, a cytology pellet, a bulk tissue preparation or a section thereof obtained for example by surgery or autopsy, lymph fluid, blood, plasma, serum, tumors, and organs. In some embodiments, the sample is from urine. Alternatively, the sample is from blood, plasma or serum. In some embodiments, the sample is from saliva.

The samples may be archival samples, having a known and documented medical outcome, or may be samples from current patients whose ultimate medical outcome is not yet known.

In some embodiments, the sample may be dissected prior to molecular analysis. The sample may be prepared via macrodissection of a bulk tumor specimen or portion thereof, or may be treated via microdissection, for example via Laser Capture Microdissection (LCM).

The sample may initially be provided in a variety of states, as fresh tissue, fresh frozen tissue, fine needle aspirates, and may be fixed or unfixed. Frequently, medical laboratories routinely prepare medical samples in a fixed state, which facilitates tissue storage. A variety of fixatives can be used to fix tissue to stabilize the morphology of cells, and may be used alone or in combination with other agents. Exemplary fixatives include crosslinking agents, alcohols, acetone, Bouin's solution, Zenker solution, Helv solution, osmic acid solution and Carnoy solution.

Crosslinking fixatives can comprise any agent suitable for forming two or more covalent bonds, for example an aldehyde. Sources of aldehydes typically used for fixation include formaldehyde, paraformaldehyde, glutaraldehyde or formalin. Preferably, the crosslinking agent comprises formaldehyde, which may be included in its native form or in the form of paraformaldehyde or formalin. One of skill in the art would appreciate that for samples in which crosslinking fixatives have been used special preparatory steps may be necessary including for example heating steps and proteinase-k digestion; see methods.

One or more alcohols may be used to fix tissue, alone or in combination with other fixatives. Exemplary alcohols used for fixation include methanol, ethanol and isopropanol.

Formalin fixation is frequently used in medical laboratories. Formalin comprises both an alcohol, typically methanol, and formaldehyde, both of which can act to fix a biological sample.

Whether fixed or unfixed, the biological sample may optionally be embedded in an embedding medium. Exemplary embedding media used in histology including paraffin, Tissue-Tek® V.I.P.™, Paramat, Paramat Extra, Paraplast, Paraplast X-tra, Paraplast Plus, Peel Away Paraffin Embedding Wax, Polyester Wax, Carbowax Polyethylene Glycol, Polyfin™, Tissue Freezing Medium TFMFM, Cryo-Gef™, and OCT Compound (Electron Microscopy Sciences, Hatfield, Pa.). Prior to molecular analysis, the embedding material may be removed via any suitable techniques, as known in the art. For example, where the sample is embedded in wax, the embedding material may be removed by extraction with organic solvent(s), for example xylenes. Kits are commercially available for removing embedding media from tissues. Samples or sections thereof may be subjected to further processing steps as needed, for example serial hydration or dehydration steps.

In some embodiments, the sample is a fixed, wax-embedded biological sample. Frequently, samples from medical laboratories are provided as fixed, wax-embedded samples, most commonly as formalin-fixed, paraffin embedded (FFPE) tissues.

Whatever the source of the biological sample, the target polynucleotide that is ultimately assayed can be prepared synthetically (in the case of control sequences), but typically is purified from the biological source and subjected to one or more preparative steps. The RNA may be purified to remove or diminish one or more undesired components from the biological sample or to concentrate it. Conversely, where the RNA is too concentrated for the particular assay, it may be diluted.

RNA Extraction

RNA can be extracted and purified from biological samples using any suitable technique. A number of techniques are known in the art, and several are commercially available (e.g., FormaPure nucleic acid extraction kit, Agencourt Biosciences, Beverly Mass., High Pure FFPE RNA Micro Kit, Roche Applied Science, Indianapolis, Ind.). RNA can be extracted from frozen tissue sections using TRIzol (Invitrogen, Carlsbad, Calif.) and purified using RNeasy Protect kit (Qiagen, Valencia, Calif.). RNA can be further purified using DNAse I treatment (Ambion, Austin, Tex.) to eliminate any contaminating DNA. RNA concentrations can be made using a Nanodrop ND-1000 spectrophotometer (Nanodrop Technologies, Rockland, Del.). RNA can be further purified to eliminate contaminants that interfere with cDNA synthesis by cold sodium acetate precipitation. RNA integrity can be evaluated by running electropherograms, and RNA integrity number (RIN, a correlative measure that indicates intactness of mRNA) can be determined using the RNA 6000 PicoAssay for the Bioanalyzer 2100 (Agilent Technologies, Santa Clara, Calif.).

Kits

Kits for performing the desired method(s) are also provided, and comprise a container or housing for holding the components of the kit, one or more vessels containing one or more nucleic acid(s), and optionally one or more vessels containing one or more reagents. The reagents include those described herein, and those reagents useful for performing the methods described, including amplification reagents, and may include one or more probes, primers or primer pairs, enzymes (including polymerases and ligases), intercalating dyes, labeled probes, and labels that can be incorporated into amplification products.

In some embodiments, the kit comprises primers or primer pairs specific for those subsets and combinations of target sequences described herein. The primers or pairs of primers suitable for selectively amplifying the target sequences. The kit may comprise at least two, three, four or five primers or pairs of primers suitable for selectively amplifying one or more targets. The kit may comprise at least 5, 10, 15, 20, 30, 40, 50, 60, 70, 80, 90, 100, 110, or more primers or pairs of primers suitable for selectively amplifying one or more targets.

In some embodiments, the primers or primer pairs of the kit, when used in an amplification reaction, specifically amplify a non-coding target, coding target, exonic, or non-exonic target described herein, a nucleic acid sequence corresponding to a target selected from Table 1 or Table 2, an RNA form thereof, or a complement to either thereof. The kit may include a plurality of such primers or primer pairs which can specifically amplify a corresponding plurality of different amplify a non-coding target, coding target, exonic, or non-exonic transcript described herein, a nucleic acid sequence corresponding to a target selected from Table 1 or Table 2, RNA forms thereof, or complements thereto. At least two, three, four or five primers or pairs of primers suitable for selectively amplifying the one or more targets can be provided in kit form. In some embodiments, the kit comprises from five to fifty primers or pairs of primers suitable for amplifying the one or more targets.

The reagents may independently be in liquid or solid form. The reagents may be provided in mixtures. Control samples and/or nucleic acids may optionally be provided in the kit. Control samples may include tissue and/or nucleic acids obtained from or representative of tumor samples from patients showing no evidence of disease, as well as tissue and/or nucleic acids obtained from or representative of tumor samples from patients that develop systemic cancer.

The nucleic acids may be provided in an array format, and thus an array or microarray may be included in the kit. The kit optionally may be certified by a government agency for use in prognosing the disease outcome of cancer patients and/or for designating a treatment modality.

Instructions for using the kit to perform one or more methods of the invention can be provided with the container, and can be provided in any fixed medium. The instructions may be located inside or outside the container or housing, and/or may be printed on the interior or exterior of any surface thereof. A kit may be in multiplex form for concurrently detecting and/or quantitating one or more different target polynucleotides representing the expressed target sequences.

Amplification and Hybridization

Following sample collection and nucleic acid extraction, the nucleic acid portion of the sample comprising RNA that is or can be used to prepare the target polynucleotide(s) of interest can be subjected to one or more preparative reactions. These preparative reactions can include in vitro transcription (IVT), labeling, fragmentation, amplification and other reactions. mRNA can first be treated with reverse transcriptase and a primer to create cDNA prior to detection, quantitation and/or amplification; this can be done in vitro with purified mRNA or in situ, e.g., in cells or tissues affixed to a slide.

By "amplification" is meant any process of producing at least one copy of a nucleic acid, in this case an expressed RNA, and in many cases produces multiple copies. An amplification product can be RNA or DNA, and may include a complementary strand to the expressed target sequence. DNA amplification products can be produced initially through reverse translation and then optionally from further amplification reactions. The amplification product may include all or a portion of a target sequence, and may optionally be labeled. A variety of amplification methods are suitable for use, including polymerase-based methods and ligation-based methods. Exemplary amplification techniques include the polymerase chain reaction method (PCR), the lipase chain reaction (LCR), ribozyme-based methods, self-sustained sequence replication (3SR), nucleic acid sequence-based amplification (NASBA), the use of Q Beta replicase, reverse transcription, nick translation, and the like.

Asymmetric amplification reactions may be used to preferentially amplify one strand representing the target sequence that is used for detection as the target polynucleotide. In some cases, the presence and/or amount of the amplification product itself may be used to determine the expression level of a given target sequence. In other instances, the amplification product may be used to hybridize to an array or other substrate comprising sensor polynucleotides which are used to detect and/or quantitate target sequence expression.

The first cycle of amplification in polymerase-based methods typically forms a primer extension product complementary to the template strand. If the template is single-stranded RNA, a polymerase with reverse transcriptase activity is used in the first amplification to reverse transcribe the RNA to DNA, and additional amplification cycles can be performed to copy the primer extension products. The primers for a PCR must, of course, be designed to hybridize to regions in their corresponding template that can produce an amplifiable segment; thus, each primer must hybridize so that its 3' nucleotide is paired to a nucleotide in its complementary template strand that is located 3' from the 3' nucleotide of the primer used to replicate that complementary template strand in the PCR.

The target polynucleotide can be amplified by contacting one or more strands of the target polynucleotide with a primer and a polymerase having suitable activity to extend the primer and copy the target polynucleotide to produce a full-length complementary polynucleotide or a smaller portion thereof. Any enzyme having a polymerase activity that can copy the target polynucleotide can be used, including DNA polymerases, RNA polymerases, reverse transcriptases, and enzymes having more than one type of polymerase or enzyme activity. The enzyme can be thermolabile or thermostable. Mixtures of enzymes can also be used. Exemplary enzymes include: DNA polymerases such as DNA Polymerase I ("Pol I"), the Klenow fragment of Pol I, T4, T7, Sequenase® T7, Sequenase® Version 2.0 T7, Tub, Taq, Tth, Pfic, Pfu, Tsp, Tfl, Tli and *Pyrococcus* sp GB-D DNA polymerases; RNA polymerases such as *E. coli*, SP6, T3 and T7 RNA polymerases; and reverse transcriptases such as AMV, M-MuLV, MMLV, RNAse H MMLV (SuperScript®), SuperScript® II, ThermoScript®, HIV-1, and RAV2 reverse transcriptases. All of these enzymes are commercially available. Exemplary polymerases with multiple specificities include RAV2 and Tli (exo-) polymerases. Exemplary thermostable polymerases include Tub, Taq, Tth, Pfic, Pfu, Tsp, Tfl, Tli and *Pyrococcus* sp. GB-D DNA polymerases.

Suitable reaction conditions are chosen to permit amplification of the target polynucleotide, including pH, buffer, ionic strength, presence and concentration of one or more salts, presence and concentration of reactants and cofactors such as nucleotides and magnesium and/or other metal ions (e.g., manganese), optional cosolvents, temperature, thermal cycling profile for amplification schemes comprising a polymerase chain reaction, and may depend in part on the polymerase being used as well as the nature of the sample. Cosolvents include formamide (typically at from about 2 to about 10%), glycerol (typically at from about 5 to about 10%), and DMSO (typically at from about 0.9 to about 10%). Techniques may be used in the amplification scheme in order to minimize the production of false positives or artifacts produced during amplification. These include "touchdown" PCR, hot-start techniques, use of nested primers, or designing PCR primers so that they form stem-loop structures in the event of primer-dimer formation and thus are not amplified. Techniques to accelerate PCR can be used, for example centrifugal PCR, which allows for greater convection within the sample, and comprising infrared heating steps for rapid heating and cooling of the sample. One or more cycles of amplification can be performed. An excess of one primer can be used to produce an excess of one primer extension product during PCR; preferably, the primer extension product produced in excess is the amplification product to be detected. A plurality of different primers may be used to amplify different target polynucleotides or different regions of a particular target polynucleotide within the sample.

An amplification reaction can be performed under conditions which allow an optionally labeled sensor polynucleotide to hybridize to the amplification product during at least part of an amplification cycle. When the assay is performed in this manner, real-time detection of this hybridization event can take place by monitoring for light emission or fluorescence during amplification, as known in the art.

Where the amplification product is to be used for hybridization to an array or microarray, a number of suitable commercially available amplification products are available. These include amplification kits available from NuGEN, Inc. (San Carlos, Calif.), including the WT-Ovation™ System, WT-Ovation™ System v2, WT-Ovation™ Pico System, WT-Ovation™ FFPE Exon Module, WT-Ovation™ FFPE Exon Module RiboAmp and RiboAmp $^{Plus}$ RNA Amplification Kits (MDS Analytical Technologies (formerly Arcturus) (Mountain View, Calif.), Genisphere, Inc. (Hatfield, Pa.), including the RampUp Plus™ and SenseAmp™ RNA Amplification kits, alone or in combination. Amplified nucleic acids may be subjected to one or more purification reactions after amplification and labeling, for example using magnetic beads (e.g., RNAClean magnetic beads, Agencourt Biosciences).

Multiple RNA biomarkers can be analyzed using realtime quantitative multiplex RT-PCR platforms and other multiplexing technologies such as GenomeLab GeXP Genetic Analysis System (Beckman Coulter, Foster City, Calif.), SmartCycler® 9600 or GeneXpert® Systems (Cepheid, Sunnyvale, Calif.), ABI 7900 HT Fast Real Time PCR system (Applied Biosystems, Foster City, Calif.), LightCycler® 480 System (Roche Molecular Systems, Pleasanton, Calif.), xMAP 100 System (Luminex, Austin, Tex.) Solexa Genome Analysis System (Illumina, Hayward, Calif.), OpenArray Real Time qPCR (BioTrove, Woburn, Mass.) and BeadXpress System (Illumina, Hayward, Calif.).

Detection and/or Quantification of Target Sequences

Any method of detecting and/or quantitating the expression of the encoded target sequences can in principle be used in the invention. The expressed target sequences can be directly detected and/or quantitated, or may be copied and/or amplified to allow detection of amplified copies of the expressed target sequences or its complement.

Methods for detecting and/or quantifying a target can include Northern blotting, sequencing, array or microarray hybridization, serial analysis of gene expression (SAGE), by enzymatic cleavage of specific structures (e.g., an Invader® assay, Third Wave Technologies, e.g. as described in U.S. Pat. Nos. 5,846,717, 6,090,543; 6,001,567; 5,985,557; and 5,994,069) and amplification methods, e.g. RT-PCR, including in a TaqMan® assay (PE Biosystems, Foster City, Calif., e.g. as described in U.S. Pat. Nos. 5,962,233 and 5,538,848), and may be quantitative or semi-quantitative, and may vary depending on the origin, amount and condition of the available biological sample. Combinations of these methods may also be used. For example, nucleic acids may be amplified, labeled and subjected to microarray analysis.

In some instances, target sequences may be detected by sequencing. Sequencing methods may comprise whole genome sequencing or exome sequencing. Sequencing methods such as Maxim-Gilbert, chain-termination, or high-throughput systems may also be used. Additional, suitable sequencing techniques include classic dideoxy sequencing reactions (Sanger method) using labeled terminators or primers and gel separation in slab or capillary, sequencing by synthesis using reversibly terminated labeled nucleotides, pyrosequencing, 454 sequencing, allele specific hybridization to a library of labeled oligonucleotide probes, sequencing by synthesis using allele specific hybridization to a library of labeled clones that is followed by ligation, real time monitoring of the incorporation of labeled nucleotides during a polymerization step, and SOLiD sequencing.

Additional methods for detecting and/or quantifying a target include single-molecule sequencing (e.g., Helicos, PacBio), sequencing by synthesis (e.g., Illumina, Ion Torrent), sequencing by ligation (e.g., ABI SOLID), sequencing by hybridization (e.g., Complete Genomics), in situ hybridization, bead-array technologies (e.g., Luminex xMAP, Illumina BeadChips), branched DNA technology (e.g., Panomics, Genisphere). Sequencing methods may use fluorescent (e.g., Illumina) or electronic (e.g., Ion Torrent, Oxford Nanopore) methods of detecting nucleotides.

Reverse Transcription for QRT-PCR Analysis

Reverse transcription can be performed by any method known in the art. For example, reverse transcription may be performed using the Omniscript kit (Qiagen, Valencia, Calif.), Superscript III kit (Invitrogen, Carlsbad, Calif.), for RT-PCR. Target-specific priming can be performed in order to increase the sensitivity of detection of target sequences and generate target-specific cDNA.

TaqMan® Gene Expression Analysis

TaqMan®-PCR can be performed using Applied Biosystems Prism (ABI) 7900 HT instruments in a 5 1.11 volume with target sequence-specific cDNA equivalent to 1 ng total RNA.

Primers and probes concentrations for TaqMan analysis are added to amplify fluorescent amplicons using PCR cycling conditions such as 95° C. for 10 minutes for one cycle, 95° C. for 20 seconds, and 60° C. for 45 seconds for 40 cycles. A reference sample can be assayed to ensure reagent and process stability. Negative controls (e.g., no template) should be assayed to monitor any exogenous nucleic acid contamination.

Classification Arrays

The present invention contemplates that a probe set or probes derived therefrom may be provided in an array format. In the context of the present invention, an "array" is a spatially or logically organized collection of polynucleotide probes. An array comprising probes specific for a coding target, non-coding target, or a combination thereof may be used. Alternatively, an array comprising probes specific for two or more of the transcripts of a target selected from Table 2, or a product derived thereof, can be used. Desirably, an array may be specific for 5, 10, 15, 20, 25, 30 or more of the transcripts of a target selected from Table 2. Probes useful for the methods of the present invention are provided in Table 1. Expression of these sequences may be detected alone or in combination with other transcripts. In some embodiments, an array is used which comprises a wide range of sensor probes for prostate-specific expression products, along with appropriate control sequences. In some instances, the array may comprise the Human Exon 1.0 ST Array (HuEx 1.0 ST, Affymetrix, Inc., Santa Clara, Calif.).

Typically the polynucleotide probes are attached to a solid substrate and are ordered so that the location (on the substrate) and the identity of each are known. The polynucleotide probes can be attached to one of a variety of solid substrates capable of withstanding the reagents and conditions necessary for use of the array. Examples include, but are not limited to, polymers, such as (poly)tetrafluoroethylene, (poly)vinylidenedifluoride, polystyrene, polycarbonate, polypropylene and polystyrene; ceramic; silicon; silicon dioxide; modified silicon; (fused) silica, quartz or glass; functionalized glass; paper, such as filter paper; diazotized cellulose; nitrocellulose filter; nylon membrane; and polyacrylamide gel pad. Substrates that are transparent to light are useful for arrays that may be used in an assay that involves optical detection.

Examples of array formats include membrane or filter arrays (for example, nitrocellulose, nylon arrays), plate arrays (for example, multiwell, such as a 24-, 96-, 256-, 384-, 864- or 1536-well, microtitre plate arrays), pin arrays, and bead arrays (for example, in a liquid "slurry"). Arrays on substrates such as glass or ceramic slides are often referred to as chip arrays or "chips." Such arrays are well known in the art. In one embodiment of the present invention, the Cancer Prognosticarray is a chip.

Data Analysis

In some embodiments, one or more pattern recognition methods can be used in analyzing the expression level of target sequences. The pattern recognition method can comprise a linear combination of expression levels, or a nonlinear combination of expression levels. In some embodiments, expression measurements for RNA transcripts or combinations of RNA transcript levels are formulated into linear or non-linear models or algorithms (e.g., an 'expression signature') and converted into a likelihood score. This likelihood score may indicate the probability that a biological sample is from a patient who will benefit from radiation therapy. Additionally, a likelihood score may indicate the probability that a biological sample is from a patient who may exhibit no evidence of disease, who may exhibit systemic cancer, or who may exhibit biochemical recurrence. The likelihood score can be used to distinguish these disease states. The models and/or algorithms can be provided in machine readable format, and may be used to correlate expression levels or an expression profile with a disease state, and/or to designate a treatment modality for a patient or class of patients.

Assaying the expression level for a plurality of targets may comprise the use of an algorithm or classifier. Array data can be managed, classified, and analyzed using techniques known in the art. Assaying the expression level for a plurality of targets may comprise probe set modeling and data pre-processing. Probe set modeling and data pre-processing can be derived using the Robust Multi-Array (RMA) algorithm or variants GC-RMA, JRMA, Probe Logarithmic Intensity Error (PLIER) algorithm, or variant iterPLIER, or Single-Channel Array Normalization (SCAN) algorithm. Variance or intensity filters can be applied to pre-process data using the RMA algorithm, for example by removing target sequences with a standard deviation of <10 or a mean intensity of <100 intensity units of a normalized data range, respectively.

Alternatively, assaying the expression level for a plurality of targets may comprise the use of a machine learning algorithm. The machine learning algorithm may comprise a supervised learning algorithm. Examples of supervised learning algorithms may include Average One-Dependence Estimators (AODE), Artificial neural network (e.g., Backpropagation), Bayesian statistics (e.g., Naive Bayes classifier, Bayesian network, Bayesian knowledge base), Case-based reasoning, Decision trees, Inductive logic programming, Gaussian process regression, Group method of data handling (GMDH), Learning Automata, Learning Vector Quantization, Minimum message length (decision trees, decision graphs, etc.), Lazy learning, Instance-based learning Nearest Neighbor Algorithm, Analogical modeling, Probably approximately correct learning (PAC) learning, Ripple down rules, a knowledge acquisition methodology, Symbolic machine learning algorithms, Subsymbolic machine learning algorithms, Support vector machines, Random Forests, Ensembles of classifiers, Bootstrap aggregating (bagging), and Boosting. Supervised learning may comprise ordinal classification such as regression analysis and Information fuzzy networks (IFN). Alternatively, supervised learning methods may comprise statistical classification, such as AODE, Linear classifiers (e.g., Fisher's linear discriminant, Logistic regression, Naive Bayes classifier, Perceptron, and Support vector machine), quadratic classifiers, k-nearest neighbor, Boosting, Decision trees (e.g., C4.5, Random forests), Bayesian networks, and Hidden Markov models.

The machine learning algorithms may also comprise an unsupervised learning algorithm. Examples of unsupervised learning algorithms may include artificial neural network, Data clustering, Expectation-maximization algorithm, Self-organizing map, Radial basis function network, Vector Quantization, Generative topographic map, Information bottleneck method, and IBSEAD. Unsupervised learning may also comprise association rule learning algorithms such as Apriori algorithm, Eclat algorithm and FP-growth algorithm. Hierarchical clustering, such as Single-linkage clustering and Conceptual clustering, may also be used. Alternatively, unsupervised learning may comprise partitional clustering such as K-means algorithm and Fuzzy clustering.

In some instances, the machine learning algorithms comprise a reinforcement learning algorithm. Examples of reinforcement learning algorithms include, but are not limited to, temporal difference learning, Q-learning and Learning Automata. Alternatively, the machine learning algorithm may comprise Data Pre-processing.

Preferably, the machine learning algorithms may include, but are not limited to, Average One-Dependence Estimators (AODE), Fisher's linear discriminant, Logistic regression, Perceptron, Multilayer Perceptron, Artificial Neural Networks, Support vector machines, Quadratic classifiers, Boosting, Decision trees, C4.5, Bayesian networks, Hidden Markov models, High-Dimensional Discriminant Analysis, and Gaussian Mixture Models. The machine learning algorithm may comprise support vector machines, Naïve Bayes classifier, k-nearest neighbor, high-dimensional discriminant analysis, or Gaussian mixture models. In some instances, the machine learning algorithm comprises Random Forests.

Therapeutic Regimens

Diagnosing, predicting, or monitoring a status or outcome of prostate cancer may comprise treating prostate cancer or preventing cancer progression. In addition, diagnosing, predicting, or monitoring a status or outcome of prostate cancer may comprise identifying or predicting which patients will be responders or non-responders to an anti-cancer therapy (e.g., radiation therapy). In some instances, diagnosing, predicting, or monitoring may comprise determining a therapeutic regimen. Determining a therapeutic regimen may comprise administering an anti-cancer therapy. Alternatively, determining a therapeutic regimen may comprise modifying, recommending, continuing or discontinuing an anti-cancer regimen. In some instances, if the sample expression patterns are consistent with the expression pattern for a known disease or disease outcome, the expression patterns can be used to designate one or more treatment modalities (e.g., therapeutic regimens, such as radiation therapy or other anti-cancer regimen). An anti-cancer regimen may comprise one or more anti-cancer therapies. Examples of anti-cancer therapies include surgery, chemotherapy, radiation therapy, immunotherapy/biological therapy, and photodynamic therapy.

For example, a patient is selected for treatment with radiation therapy if the patient is identified as likely to be responsive to radiation therapy based on an expression profile or PORTOS, as described herein. The radiation used in treatment can come from a machine outside the body (external-beam radiation therapy) or from radioactive material placed in the body near cancer cells (internal radiation therapy, more commonly called brachytherapy). Systemic radiation therapy uses a radioactive substance, given by mouth or into a vein that travels in the blood to tissues throughout the body.

External-beam radiation therapy may be delivered in the form of photon beams (either x-rays or gamma rays). A photon is the basic unit of light and other forms of electromagnetic radiation. An example of external-beam radiation therapy is called 3-dimensional conformal radiation therapy (3D-CRT). 3D-CRT may use computer software and advanced treatment machines to deliver radiation to very precisely shaped target areas. Many other methods of external-beam radiation therapy are currently being tested and used in cancer treatment. These methods include, but are not limited to, intensity-modulated radiation therapy (IMRT), image-guided radiation therapy (IGRT), Stereotactic radiosurgery (SRS), Stereotactic body radiation therapy (SBRT), and proton therapy.

Intensity-modulated radiation therapy (IMRT) is an example of external-beam radiation and may use hundreds of tiny radiation beam-shaping devices, called collimators, to deliver a single dose of radiation. The collimators can be stationary or can move during treatment, allowing the intensity of the radiation beams to change during treatment sessions. This kind of dose modulation allows different areas of a tumor or nearby tissues to receive different doses of radiation. IMRT is planned in reverse (called inverse treatment planning). In inverse treatment planning, the radiation doses to different areas of the tumor and surrounding tissue are planned in advance, and then a high-powered computer program calculates the required number of beams and angles of the radiation treatment. In contrast, during traditional (forward) treatment planning, the number and angles of the radiation beams are chosen in advance and computers calculate how much dose may be delivered from each of the planned beams. The goal of IMRT is to increase the radiation dose to the areas that need it and reduce radiation exposure to specific sensitive areas of surrounding normal tissue.

Another example of external-beam radiation is image-guided radiation therapy (IGRT). In IGRT, repeated imaging scans (CT, MRI, or PET) may be performed during treatment. These imaging scans may be processed by computers to identify changes in a tumor's size and location due to treatment and to allow the position of the patient or the planned radiation dose to be adjusted during treatment as needed. Repeated imaging can increase the accuracy of radiation treatment and may allow reductions in the planned volume of tissue to be treated, thereby decreasing the total radiation dose to normal tissue.

Tomotherapy is a type of image-guided IMRT. A tomotherapy machine is a hybrid between a CT imaging scanner and an external-beam radiation therapy machine. The part of the tomotherapy machine that delivers radiation for both imaging and treatment can rotate completely around the patient in the same manner as a normal CT scanner. Tomotherapy machines can capture CT images of the patient's tumor immediately before treatment sessions, to allow for very precise tumor targeting and sparing of normal tissue.

Stereotactic radiosurgery (SRS) can deliver one or more high doses of radiation to a small tumor. SRS uses extremely accurate image-guided tumor targeting and patient positioning. Therefore, a high dose of radiation can be given without excess damage to normal tissue. SRS can be used to treat small tumors with well-defined edges. It is most commonly used in the treatment of brain or spinal tumors and brain metastases from other cancer types. For the treatment of some brain metastases, patients may receive radiation therapy to the entire brain (called whole-brain radiation therapy) in addition to SRS. SRS requires the use of a head frame or other device to immobilize the patient during treatment to ensure that the high dose of radiation is delivered accurately.

Stereotactic body radiation therapy (SBRT) delivers radiation therapy in fewer sessions, using smaller radiation fields and higher doses than 3D-CRT in most cases. SBRT may treat tumors that lie outside the brain and spinal cord. Because these tumors are more likely to move with the normal motion of the body, and therefore cannot be targeted as accurately as tumors within the brain or spine, SBRT is usually given in more than one dose. SBRT can be used to treat small, isolated tumors, including cancers in the lung and liver. SBRT systems may be known by their brand names, such as the CyberKnife®.

In proton therapy, external-beam radiation therapy may be delivered by proton. Protons are a type of charged particle. Proton beams differ from photon beams mainly in the way they deposit energy in living tissue. Whereas photons deposit energy in small packets all along their path through tissue, protons deposit much of their energy at the end of their path (called the Bragg peak) and deposit less energy along the way. Use of protons may reduce the exposure of normal tissue to radiation, possibly allowing the delivery of higher doses of radiation to a tumor.

Other charged particle beams such as electron beams may be used to irradiate superficial tumors, such as skin cancer or tumors near the surface of the body, but they cannot travel very far through tissue.

Internal radiation therapy (brachytherapy) is radiation delivered from radiation sources (radioactive materials) placed inside or on the body. Several brachytherapy techniques are used in cancer treatment. Interstitial brachytherapy may use a radiation source placed within tumor tissue, such as within a prostate tumor. Intracavitary brachytherapy may use a source placed within a surgical cavity or a body cavity, such as the chest cavity, near a tumor. Episcleral brachytherapy, which may be used to treat melanoma inside the eye, may use a source that is attached to the eye. In brachytherapy, radioactive isotopes can be sealed in tiny pellets or "seeds." These seeds may be placed in patients using delivery devices, such as needles, catheters, or some other type of carrier. As the isotopes decay naturally, they give off radiation that may damage nearby cancer cells. Brachytherapy may be able to deliver higher doses of radiation to some cancers than external-beam radiation therapy while causing less damage to normal tissue.

Brachytherapy can be given as a low-dose-rate or a high-dose-rate treatment. In low-dose-rate treatment, cancer cells receive continuous low-dose radiation from the source over a period of several days. In high-dose-rate treatment, a robotic machine attached to delivery tubes placed inside the body may guide one or more radioactive sources into or near a tumor, and then removes the sources at the end of each treatment session. High-dose-rate treatment can be given in one or more treatment sessions. An example of a high-dose-rate treatment is the MammoSite® system. Bracytherapy may be used to treat patients with breast cancer who have undergone breast-conserving surgery.

The placement of brachytherapy sources can be temporary or permanent. For permanent brachytherapy, the sources may be surgically sealed within the body and left there, even after all of the radiation has been given off. In some instances, the remaining material (in which the radioactive isotopes were sealed) does not cause any discomfort or harm to the patient. Permanent brachytherapy is a type of low-dose-rate brachytherapy. For temporary brachytherapy, tubes (catheters) or other carriers are used to deliver the radiation sources, and both the carriers and the radiation sources are removed after treatment. Temporary brachytherapy can be either low-dose-rate or high-dose-rate treatment. Brachytherapy may be used alone or in addition to external-beam radiation therapy to provide a "boost" of radiation to a tumor while sparing surrounding normal tissue.

In systemic radiation therapy, a patient may swallow or receive an injection of a radioactive substance, such as radioactive iodine or a radioactive substance bound to a monoclonal antibody. Radioactive iodine (131I) is a type of systemic radiation therapy commonly used to help treat cancer, such as thyroid cancer. Thyroid cells naturally take up radioactive iodine. For systemic radiation therapy for some other types of cancer, a monoclonal antibody may help target the radioactive substance to the right place. The antibody joined to the radioactive substance travels through the blood, locating and killing tumor cells. For example, the drug ibritumomab tiuxetan (Zevalin®) may be used for the treatment of certain types of B-cell non-Hodgkin lymphoma (NHL). The antibody part of this drug recognizes and binds to a protein found on the surface of B lymphocytes. The combination drug regimen of tositumomab and iodine I 131 tositumomab (Bexxar®) may be used for the treatment of certain types of cancer, such as NHL. In this regimen, nonradioactive tositumomab antibodies may be given to patients first, followed by treatment with tositumomab antibodies that have 131I attached. Tositumomab may recognize and bind to the same protein on B lymphocytes as ibritumomab. The nonradioactive form of the antibody may help protect normal B lymphocytes from being damaged by radiation from 131I.

Some systemic radiation therapy drugs relieve pain from cancer that has spread to the bone (bone metastases). This is a type of palliative radiation therapy. The radioactive drugs samarium-153-lexidronam (Quadramet®) and strontium-89 chloride (Metastron®) are examples of radiopharmaceuticals may be used to treat pain from bone metastases.

In addition, patients, especially those not identified as likely to benefit from radiation therapy, may be administered other cancer treatments such as, but not limited to, surgery, chemotherapy, immunotherapy, hormonal therapy, biologic therapy, or any combination thereof.

Surgical oncology uses surgical methods to diagnose, stage, and treat cancer, and to relieve certain cancer-related symptoms. Surgery may be used to remove the tumor (e.g., excisions, resections, debulking surgery), reconstruct a part of the body (e.g., restorative surgery), and/or to relieve symptoms such as pain (e.g., palliative surgery). Surgery may also include cryosurgery. Cryosurgery (also called cryotherapy) may use extreme cold produced by liquid nitrogen (or argon gas) to destroy abnormal tissue. Cryosurgery can be used to treat external tumors, such as those on the skin. For external tumors, liquid nitrogen can be applied directly to the cancer cells with a cotton swab or spraying device. Cryosurgery may also be used to treat tumors inside the body (internal tumors and tumors in the bone). For internal tumors, liquid nitrogen or argon gas may be circulated through a hollow instrument called a cryoprobe, which is placed in contact with the tumor. An ultrasound or MRI may be used to guide the cryoprobe and monitor the freezing of the cells, thus limiting damage to nearby healthy tissue. A ball of ice crystals may form around the probe, freezing nearby cells. Sometimes more than one probe is used to deliver the liquid nitrogen to various parts of the tumor. The probes may be put into the tumor during surgery or through the skin (percutaneously). After cryosurgery, the frozen tissue thaws and may be naturally absorbed by the body (for internal tumors), or may dissolve and form a scab (for external tumors).

Chemotherapeutic agents may also be used for the treatment of prostate cancer. Examples of chemotherapeutic agents include alkylating agents, anti-metabolites, plant alkaloids and terpenoids, *Vinca* alkaloids, podophyllotoxin, taxanes, topoisomerase inhibitors, and cytotoxic antibiotics. Cisplatin, carboplatin, and oxaliplatin are examples of alkylating agents. Other alkylating agents include mechlorethamine, cyclophosphamide, chlorambucil, ifosfamide. Alkylating agents may impair cell function by forming covalent bonds with the amino, carboxyl, sulfhydryl, and phosphate groups in biologically important molecules. Alternatively, alkylating agents may chemically modify a cell's DNA.

Anti-metabolites are another example of chemotherapeutic agents. Anti-metabolites may masquerade as purines or pyrimidines and may prevent purines and pyrimidines from becoming incorporated in to DNA during the "S" phase (of the cell cycle), thereby stopping normal development and division. Antimetabolites may also affect RNA synthesis. Examples of metabolites include azathioprine and mercaptopurine.

Alkaloids may be derived from plants and block cell division may also be used for the treatment of cancer. Alkyloids may prevent microtubule function. Examples of alkaloids are *Vinca* alkaloids and taxanes. *Vinca* alkaloids may bind to specific sites on tubulin and inhibit the assembly of tubulin into microtubules (M phase of the cell cycle). The *Vinca* alkaloids may be derived from the Madagascar periwinkle, *Catharanthus roseus* (formerly known as *Vinca rosea*). Examples of *Vinca* alkaloids include, but are not limited to, vincristine, vinblastine, vinorelbine, or vindesine. Taxanes are diterpenes produced by the plants of the genus *Taxus* (yews). Taxanes may be derived from natural sources or synthesized artificially. Taxanes include paclitaxel (Taxol) and docetaxel (Taxotere). Taxanes may disrupt microtubule function. Microtubules are essential to cell division, and taxanes may stabilize GDP-bound tubulin in the microtubule, thereby inhibiting the process of cell division. Thus, in essence, taxanes may be mitotic inhibitors. Taxanes may also be radiosensitizing and often contain numerous chiral centers.

Alternative chemotherapeutic agents include podophyllotoxin. Podophyllotoxin is a plant-derived compound that may help with digestion and may be used to produce cytostatic drugs such as etoposide and teniposide. They may prevent the cell from entering the G1 phase (the start of DNA replication) and the replication of DNA (the S phase).

Topoisomerases are essential enzymes that maintain the topology of DNA. Inhibition of type I or type II topoisomerases may interfere with both transcription and replication of DNA by upsetting proper DNA supercoiling. Some chemotherapeutic agents may inhibit topoisomerases. For example, some type I topoisomerase inhibitors include camptothecins: irinotecan and topotecan. Examples of type II inhibitors include amsacrine, etoposide, etoposide phosphate, and teniposide.

Another example of chemotherapeutic agents is cytotoxic antibiotics. Cytotoxic antibiotics are a group of antibiotics that are used for the treatment of cancer because they may interfere with DNA replication and/or protein synthesis. Cytotoxic antiobiotics include, but are not limited to, actinomycin, anthracyclines, doxorubicin, daunorubicin, valrubicin, idarubicin, epirubicin, bleomycin, plicamycin, and mitomycin.

Alternatively or additionally, the anti-cancer treatment may comprise immunotherapy (sometimes called, biological therapy, biotherapy, biologic therapy, or biological response modifier (BRM) therapy), which uses the body's immune system, either directly or indirectly, to fight cancer or to lessen the side effects that may be caused by some cancer treatments. Immunotherapies include interferons, interleukins, colony-stimulating factors, monoclonal antibodies, vaccines, immune cell-based therapy, gene therapy, and nonspecific immunomodulating agents.

Interferons (IFNs) are types of cytokines that occur naturally in the body. Interferon alpha, interferon beta, and interferon gamma are examples of interferons that may be used in cancer treatment.

Like interferons, interleukins (ILs) are cytokines that occur naturally in the body and can be made in the laboratory. Many interleukins have been identified for the treatment of cancer. For example, interleukin-2 (IL-2 or aldesleukin), interleukin 7, and interleukin 12 have may be used as an anti-cancer treatment. IL-2 may stimulate the growth and activity of many immune cells, such as lymphocytes, that can destroy cancer cells. Interleukins may be used to treat a number of cancers, including leukemia, lymphoma, and brain, colorectal, ovarian, breast, kidney and prostate cancers.

Colony-stimulating factors (CSFs) (sometimes called hematopoietic growth factors) may also be used for the treatment of cancer. Some examples of CSFs include, but are not limited to, G-CSF (filgrastim) and GM-CSF (sargramostim). CSFs may promote the division of bone marrow stem cells and their development into white blood cells, platelets, and red blood cells. Bone marrow is critical to the body's immune system because it is the source of all blood cells. Because anticancer drugs can damage the body's ability to make white blood cells, red blood cells, and platelets, stimulation of the immune system by CSFs may benefit patients undergoing other anti-cancer treatment, thus CSFs may be combined with other anti-cancer therapies, such as chemotherapy. CSFs may be used to treat a large variety of cancers, including lymphoma, leukemia, multiple myeloma, melanoma, and cancers of the brain, lung, esophagus, breast, uterus, ovary, prostate, kidney, colon, and rectum.

Another type of immunotherapy includes monoclonal antibodies (MOABs or MoABs). These antibodies may be produced by a single type of cell and may be specific for a particular antigen. To create MOABs, a human cancer cells may be injected into mice. In response, the mouse immune system can make antibodies against these cancer cells. The mouse plasma cells that produce antibodies may be isolated and fused with laboratory-grown cells to create "hybrid" cells called hybridomas. Hybridomas can indefinitely produce large quantities of these pure antibodies, or MOABs. MOABs may be used in cancer treatment in a number of ways. For instance, MOABs that react with specific types of cancer may enhance a patient's immune response to the cancer. MOABs can be programmed to act against cell growth factors, thus interfering with the growth of cancer cells.

MOABs may be linked to other anti-cancer therapies such as chemotherapeutics, radioisotopes (radioactive substances), other biological therapies, or other toxins. When the antibodies latch onto cancer cells, they deliver these anti-cancer therapies directly to the tumor, helping to destroy it. MOABs carrying radioisotopes may also prove useful in diagnosing certain cancers, such as colorectal, ovarian, and prostate.

Rituxan® (rituximab) and Herceptin® (trastuzumab) are examples of MOABs that may be used as a biological therapy. Rituxan may be used for the treatment of non-Hodgkin lymphoma. Herceptin can be used to treat metastatic breast cancer in patients with tumors that produce excess amounts of a protein called HER2. Alternatively, MOABs may be used to treat lymphoma, leukemia, melanoma, and cancers of the brain, breast, lung, kidney, colon, rectum, ovary, prostate, and other areas.

Cancer vaccines are another form of immunotherapy. Cancer vaccines may be designed to encourage the patient's immune system to recognize cancer cells. Cancer vaccines may be designed to treat existing cancers (therapeutic vaccines) or to prevent the development of cancer (prophylactic vaccines). Therapeutic vaccines may be injected in a person after cancer is diagnosed. These vaccines may stop the growth of existing tumors, prevent cancer from recurring, or eliminate cancer cells not killed by prior treatments. Cancer vaccines given when the tumor is small may be able to eradicate the cancer. On the other hand, prophylactic vaccines are given to healthy individuals before cancer develops. These vaccines are designed to stimulate the immune system to attack viruses that can cause cancer. By targeting these cancer-causing viruses, development of certain cancers may be prevented. For example, cervarix and gardasil are vaccines to treat human papilloma virus and may prevent cervical cancer. Therapeutic vaccines may be used to treat melanoma, lymphoma, leukemia, and cancers of the brain, breast, lung, kidney, ovary, prostate, pancreas, colon, and rectum. Cancer vaccines can be used in combination with other anti-cancer therapies.

Immune cell-based therapy is also another form of immunotherapy. Adoptive cell transfer may include the transfer of immune cells such as dendritic cells, T cells (e.g., cytotoxic T cells), or natural killer (NK) cells to activate a cytotoxic response or attack cancer cells in a patient. Autologous immune cell-based therapy involves the transfer of a patient's own immune cells after expansion in vitro.

Gene therapy is another example of a biological therapy. Gene therapy may involve introducing genetic material into a person's cells to fight disease. Gene therapy methods may improve a patient's immune response to cancer. For example, a gene may be inserted into an immune cell to enhance its ability to recognize and attack cancer cells. In another approach, cancer cells may be injected with genes that cause the cancer cells to produce cytokines and stimulate the immune system.

In some instances, biological therapy includes nonspecific immunomodulating agents. Nonspecific immunomodulating agents are substances that stimulate or indirectly augment the immune system. Often, these agents target key immune system cells and may cause secondary responses such as increased production of cytokines and immunoglobulins. Two nonspecific immunomodulating agents used in cancer treatment are *bacillus* Calmette-Guerin (BCG) and levamisole. BCG may be used in the treatment of superficial bladder cancer following surgery. BCG may work by stimulating an inflammatory, and possibly an immune, response. A solution of BCG may be instilled in the bladder. Levamisole is sometimes used along with fluorouracil (5-FU) chemotherapy in the treatment of stage III (Dukes' C) colon cancer following surgery. Levamisole may act to restore depressed immune function.

Photodynamic therapy (PDT) is an anti-cancer treatment that may use a drug, called a photosensitizer or photosensitizing agent, and a particular type of light. When photosensitizers are exposed to a specific wavelength of light, they may produce a form of oxygen that kills nearby cells. A photosensitizer may be activated by light of a specific wavelength. This wavelength determines how far the light can travel into the body. Thus, photosensitizers and wavelengths of light may be used to treat different areas of the body with PDT.

In the first step of PDT for cancer treatment, a photosensitizing agent may be injected into the bloodstream. The agent may be absorbed by cells all over the body but may stay in cancer cells longer than it does in normal cells. Approximately 24 to 72 hours after injection, when most of the agent has left normal cells but remains in cancer cells, the tumor can be exposed to light. The photosensitizer in the tumor can absorb the light and produces an active form of oxygen that destroys nearby cancer cells. In addition to directly killing cancer cells, PDT may shrink or destroy tumors in two other ways. The photosensitizer can damage blood vessels in the tumor, thereby preventing the cancer from receiving necessary nutrients. PDT may also activate the immune system to attack the tumor cells.

The light used for PDT can come from a laser or other sources. Laser light can be directed through fiber optic cables (thin fibers that transmit light) to deliver light to areas inside the body. For example, a fiber optic cable can be inserted through an endoscope (a thin, lighted tube used to look at tissues inside the body) into the lungs or esophagus to treat cancer in these organs. Other light sources include light-emitting diodes (LEDs), which may be used for surface tumors, such as skin cancer. PDT is usually performed as an outpatient procedure. PDT may also be repeated and may be used with other therapies, such as surgery, radiation, or chemotherapy.

Extracorporeal photopheresis (ECP) is a type of PDT in which a machine may be used to collect the patient's blood cells. The patient's blood cells may be treated outside the body with a photosensitizing agent, exposed to light, and then returned to the patient. ECP may be used to help lessen the severity of skin symptoms of cutaneous T-cell lymphoma that has not responded to other therapies. ECP may be used to treat other blood cancers, and may also help reduce rejection after transplants.

Additionally, photosensitizing agent, such as porfimer sodium or Photofrin®, may be used in PDT to treat or relieve the symptoms of esophageal cancer and non-small cell lung cancer. Porfimer sodium may relieve symptoms of esophageal cancer when the cancer obstructs the esophagus or when the cancer cannot be satisfactorily treated with laser therapy alone. Porfimer sodium may be used to treat non-small cell lung cancer in patients for whom the usual treatments are not appropriate, and to relieve symptoms in patients with non-small cell lung cancer that obstructs the airways. Porfimer sodium may also be used for the treatment of precancerous lesions in patients with Barrett esophagus, a condition that can lead to esophageal cancer.

Laser therapy may use high-intensity light to treat cancer and other illnesses. Lasers can be used to shrink or destroy tumors or precancerous growths. Lasers are most commonly used to treat superficial cancers (cancers on the surface of the body or the lining of internal organs) such as basal cell skin cancer and the very early stages of some cancers, such as cervical, penile, vaginal, vulvar, and non-small cell lung cancer.

Lasers may also be used to relieve certain symptoms of cancer, such as bleeding or obstruction. For example, lasers can be used to shrink or destroy a tumor that is blocking a patient's trachea (windpipe) or esophagus. Lasers also can be used to remove colon polyps or tumors that are blocking the colon or stomach.

Laser therapy is often given through a flexible endoscope (a thin, lighted tube used to look at tissues inside the body). The endoscope is fitted with optical fibers (thin fibers that transmit light). It is inserted through an opening in the body, such as the mouth, nose, anus, or vagina. Laser light is then precisely aimed to cut or destroy a tumor.

Laser-induced interstitial thermotherapy (LITT), or interstitial laser photocoagulation, also uses lasers to treat some cancers. LITT is similar to a cancer treatment called hyperthermia, which uses heat to shrink tumors by damaging or killing cancer cells. During LITT, an optical fiber is inserted into a tumor. Laser light at the tip of the fiber raises the temperature of the tumor cells and damages or destroys them. LITT is sometimes used to shrink tumors in the liver.

Laser therapy can be used alone, but most often it is combined with other treatments, such as surgery, chemotherapy, or radiation therapy. In addition, lasers can seal nerve endings to reduce pain after surgery and seal lymph vessels to reduce swelling and limit the spread of tumor cells.

Lasers used to treat cancer may include carbon dioxide ($CO_2$) lasers, argon lasers, and neodymium:yttrium-aluminum-garnet (Nd:YAG) lasers. Each of these can shrink or destroy tumors and can be used with endoscopes. $CO_2$ and argon lasers can cut the skin's surface without going into deeper layers. Thus, they can be used to remove superficial cancers, such as skin cancer. In contrast, the Nd:YAG laser is more commonly applied through an endoscope to treat internal organs, such as the uterus, esophagus, and colon. Nd:YAG laser light can also travel through optical fibers into specific areas of the body during LITT. Argon lasers are often used to activate the drugs used in PDT.

For patients with systemic disease after a prostatectomy, systemic radiation therapy (e.g., samarium or strontium) may be combined with additional treatment modalities such as adjuvant chemotherapy (e.g., docetaxel, mitoxantrone, cabazitaxel, estramustine and prednisone), and/or hormone therapy including anti-androgen therapy (e.g., surgical castration, finasteride, flutamide, bicalutamide, niltamide, enzalutamide, ketoconazole and dutasteride); lutenizing hormone releasing hormone (LHRH) agonists, (leuprolide, goserelin, triptorelin and histrelin) and/or LHRH antagonists, also known as gonadotropin-releasing hormone antagonists, (degarelix, ganirelix, cetrorelix and abarelix). Such patients would likely be treated immediately with radiation therapy either alone or in combination with one or more other treatment modalities in order to eliminate presumed micrometastatic disease.

Such patients can also be more closely monitored for signs of disease progression. For patients with biochemical recurrence only (BCR-only or elevated PSA that does not rapidly become manifested as systemic disease), only localized adjuvant therapy (e.g., radiation therapy of the prostate bed) or a short course of anti-androgen therapy would likely be administered. For patients with no evidence of disease (NED), adjuvant therapy would not likely be recommended by their physicians in order to avoid treatment-related side effects such as metabolic syndrome (e.g., hypertension, diabetes and/or weight gain), osteoporosis, proctitis, incontinence or impotence. Patients with NED could be designated for watchful waiting, or for no treatment. Patients with systemic disease, but who have successive PSA increases, could be designated for watchful waiting, increased monitoring, or lower dose or shorter duration radiation therapy.

Target sequences can be grouped so that information obtained about the set of target sequences in the group can be used to make or assist in making a clinically relevant judgment such as a diagnosis, prognosis, or treatment choice.

A patient report is also provided comprising a representation of measured expression levels of a plurality of target sequences in a biological sample from the patient, wherein the representation comprises expression levels of target sequences corresponding to any one, two, three, four, five, six, eight, ten, twenty, or more of the target sequences corresponding to a target selected from Table 1 or Table 2, the subsets described herein, or a combination thereof. In some embodiments, the representation of the measured expression level(s) may take the form of a linear or nonlinear combination of expression levels of the target sequences of interest. The patient report may further include a PORTOS. The patient report may be provided in a machine (e.g., a computer) readable format and/or in a hard (paper) copy. The report can also include standard measurements of expression levels of said plurality of target sequences from one or more sets of patients with known disease status and/or outcome. The report can be used to inform the patient and/or treating physician of the expression levels of the expressed target sequences, the likely medical diagnosis and/or implications, and optionally may recommend a treatment modality (e.g., radiation therapy) for the patient.

Also provided are representations of the gene expression profiles useful for treating, diagnosing, prognosticating, and otherwise assessing disease. In some embodiments, these profile representations are reduced to a medium that can be automatically read by a machine such as computer readable media (magnetic, optical, and the like). The articles can also include instructions for assessing the gene expression profiles in such media. For example, the articles may comprise a readable storage form having computer instructions for comparing gene expression profiles of the portfolios of genes described above and/or calculating a PORTOS based on the gene expression profiles. The articles may also have gene expression profiles digitally recorded therein so that they may be compared with gene expression data from patient samples. Alternatively, the profiles can be recorded in different representational format. A graphical recordation is one such format. Clustering algorithms can assist in the visualization of such data.

Prediction of Treatment Response to Radiation Therapy

A radiation response genomic signature can be utilized to predict whether or not a patient who has prostate cancer will benefit from radiation therapy. In particular, a post-operative radiation therapy outcome score (PORTOS) can be calculated based on the levels of expression of a plurality of genes selected from Table 2 to determine whether or not the subject is likely to benefit from post-operative radiation therapy (see Examples). A PORTOS greater than 0 (i.e., high PORTOS) indicates that a subject will benefit from post-operative radiation therapy, whereas a PORTOS of less than or equal to 0 (i.e., low PORTOS) indicates that a subject will not benefit from post-operative radiation therapy. Thus, patients with high PORTOS signature scores are more likely to benefit from radiation treatment after surgery and may be prescribed or administered radiation therapy.

III. Experimental

Below are examples of specific embodiments for carrying out the present invention. The examples are offered for illustrative purposes only, and are not intended to limit the scope of the present invention in any way.

Efforts have been made to ensure accuracy with respect to numbers used (e.g., amounts, temperatures, etc.), but some experimental error and deviation should, of course, be allowed for.

EXAMPLES

Example 1: Development of a Genetic Signature to Predict Post-Operative Radiation Therapy Response in Prostate Cancer Patients DNA Damage Repair (DDR) genes and pathways are significantly associated with increased metastatic progression risk (Evans et al., Patient-Level DNA Damage and Repair Pathway Profiles and Prognosis After Prostatectomy for High-Risk Prostate Cancer, JAMA Oncol. 2016 January 7:1-10). DDR genes were evaluated for their utility in a radiation response signature prostate cancer patients following prostatectomy. An 1800 gene compilation from Gene Ontology (GO) and Gene Set Enrichment Analysis (GSEA) related to response to DNA damage and radiation and in the Human Exon Array platform were collected to identify a subset of genes having the most potential to predict response to radiation therapy (RT).

To develop a post-operative radiation therapy response signature, a 1:1 matching was performed for patients treated and untreated with RT within a year in the MCI case-control prostatectomy cohort (Erho et al., Discovery and validation of a prostate cancer genomic classifier that predicts early metastasis following radical prostatectomy. PLoS One 2013; 8: e66855). Prostate cancer patients considered "treated" received adjuvant or salvage post-operative radiation after radical prostatectomy and before the primary endpoint of metastasis. Matching between treated and untreated arms was performed on Gleason score, pre-operative prostate specific antigen (PSA), positive surgical margins (SM), extracapsular extension (ECE), seminal vesicle invasion (SVI), lymph node invasion (LNI), and androgen deprivation therapy (ADT). Gleason score was categorized into low (<7), intermediate (7), and high (8-10). Similarly, PSA was stratified into low (<10 ng/dL), intermediate (10-20 ng/dL), and high (>20 ng/dL). SM, ECE, SVI, and LNI were treated as binary variables and defined by the respective institutions. The resulting matched training prostatectomy cohort (N=196) with whole-genome expression profiles was used to develop the radiation response signature.

Using the training cohort, each of the 1800 genes was ranked in order of its univariate interaction p-value in a Cox proportional hazards model. This ranked gene list was used to train a ridge-penalized Cox model, using metastasis as the endpoint, and with treatment and the interaction terms of treatment and each gene as the variables. Feature selection was performed by varying the number of included features from 10 to 25 (9 to 24 genes in addition to treatment) in order to range from approximately 10 to 4 events per variable in the training cohort. The final gene list was the model that minimized the interaction p-value in the training cohort. The predictions from the model are calculated by taking the difference of the predictions without RT and with RT, and converting to binary scores using a cutoff of 0. The resulting score is the Post-Operative Radiation Therapy Outcome Score (PORTOS) where patients with scores greater than 0 (high PORTOS) benefit from treatment, and patients with scores less than or equal to 0 (low PORTOS) do not benefit from treatment. As a result a 24-gene model was developed using ridge-penalized Cox regression to model the interactions of the genes and radiation therapy to generate the PORTOS [Table 2]. The model was then applied to the independent validation cohort.

TABLE 2

A list of the 24 genes in PORTOS model with their regression coefficients

| Gene | Coefficient | Gene | Coefficient |
| --- | --- | --- | --- |
| DRAM1 | −0.102 | HCLS1 | −0.008 |
| KRT14 | −0.847 | DTL | 1.161 |
| PTPN22 | −1.029 | IL7R | 0.135 |
| ZMAT3 | 0.118 | UBA7 | 0.291 |
| ARHGAP15 | −1.114 | NEK1 | 0.678 |
| IL1B | −1.502 | CDKN2AIP | 0.466 |
| ANLN | −1.233 | APEX2 | 0.671 |
| RPS27A | 0.364 | KIF23 | 1.01 |
| MUM1 | 0.444 | SULF2 | −0.288 |
| TOP2A | 1.378 | PLK2 | −1.294 |
| GNG11 | 0.41 | EME1 | 1.39 |
| CDKN3 | −0.848 | BIN2 | 0.529 |

Figure 1B:
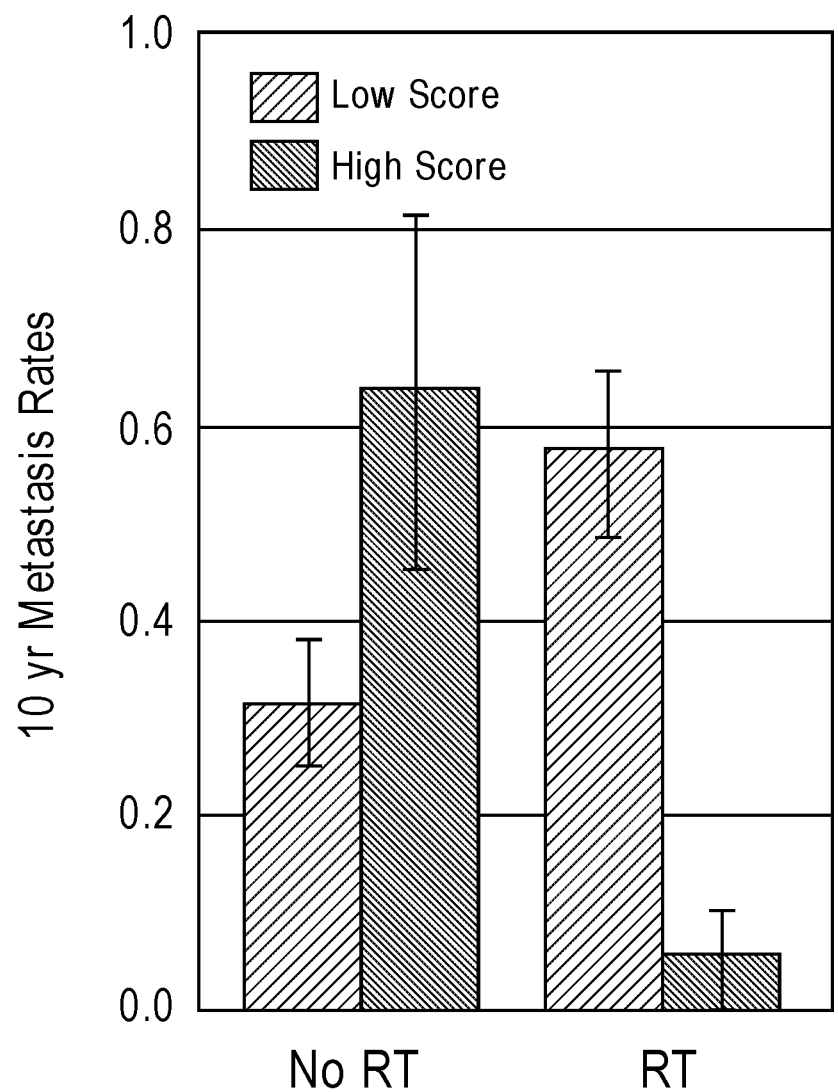
Figure 2A:
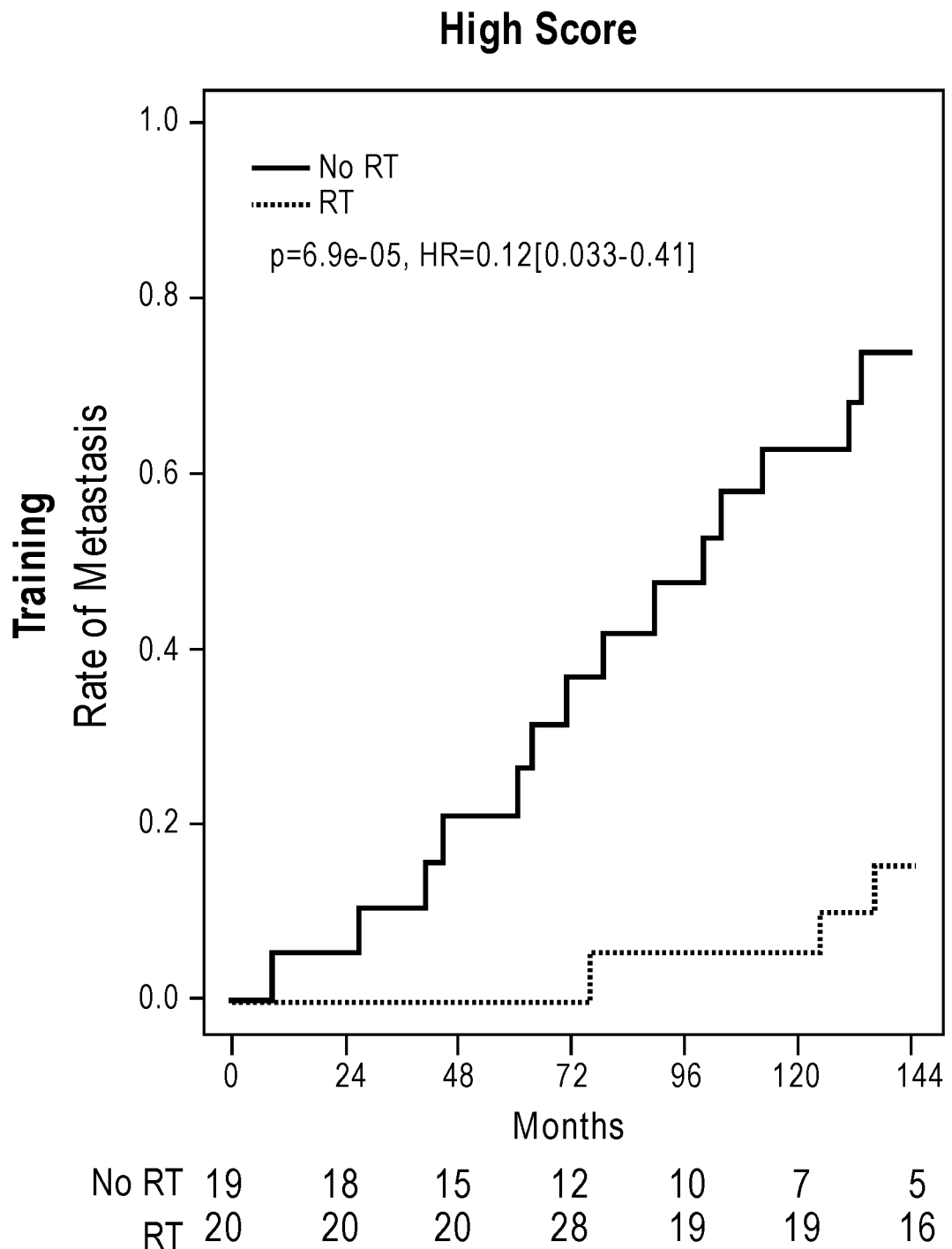
FIGS. 2A-2D show cumulative incidence curves in the training and validation cohorts separating low and high PORTOS scores.
Figure 2B:
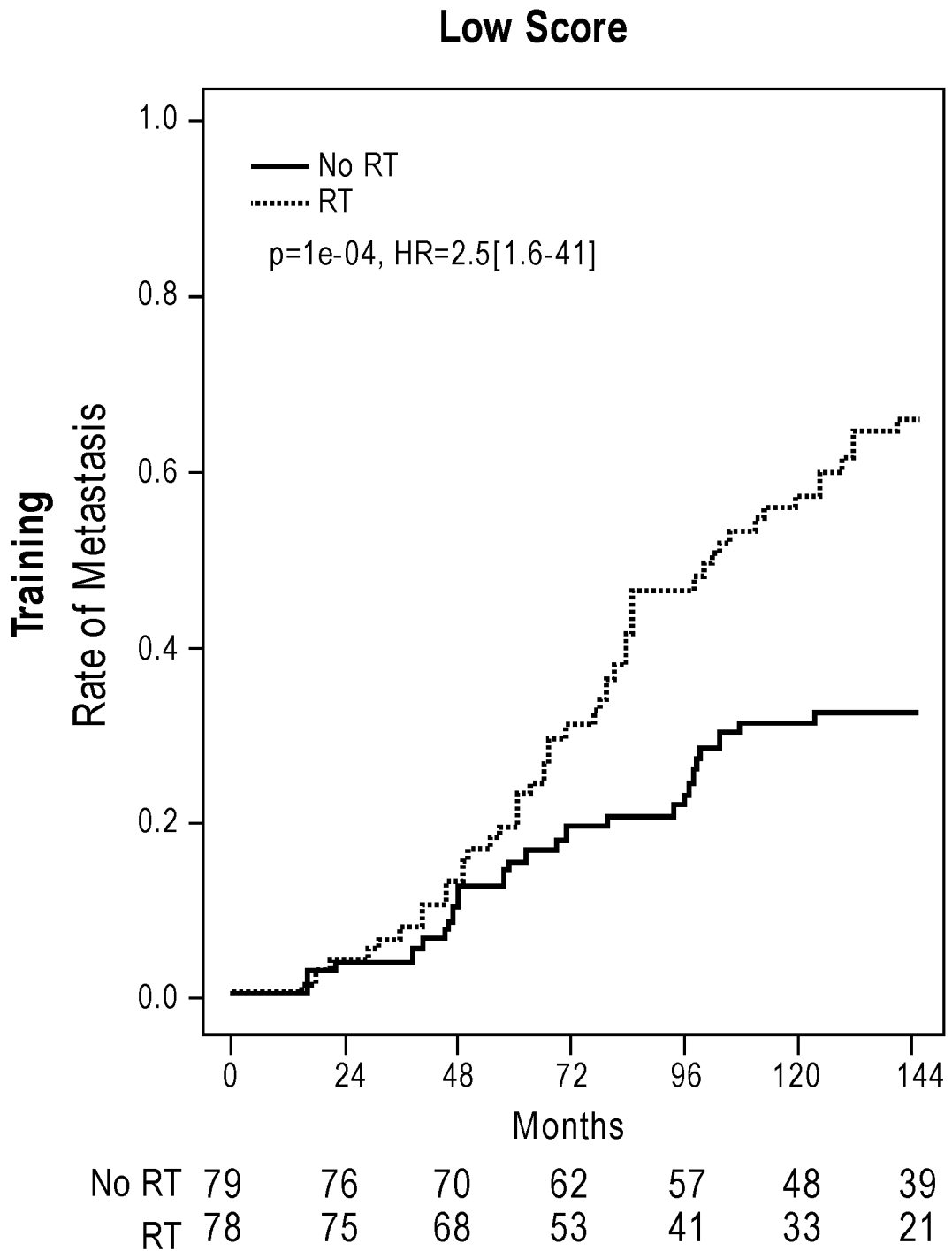

Example 2: PORTOS is Predictive of Response to Radiation Therapy in Prostate Cancer Patients In the matched training cohort, PORTOS was able to predict response to radiation therapy (RT) as evidenced by the significant interaction term (p<0.0001, FIG. 1A). In patients with high scores (PORTOS>0), treated patients had better outcomes than untreated patients with a 10-year metastasis rate of 5% in RT treated patients and 63% in untreated patients (p<0.0001, HR=0.12 [0.033-0.41], FIGS. 1B and 2A), whereas in patients with low scores (PORTOS<0), untreated patients had better outcomes with a 10-year metastasis rate of 31%, compared to 57% in RT treated patients (p=0.0001, HR=2.5 [1.6-4.1], FIGS. 1B and 2B). These results showed that the PORTOS of the present invention was useful for predicting benefit from post-operative RT in patients with prostate cancer. These results also indicated that the methods of the present invention are useful for treating prostate cancer. These results further indicated that methods of the present invention are useful for predicting response to post-operative radiation therapy and treating a subject for prostate cancer.

Figure 1C:
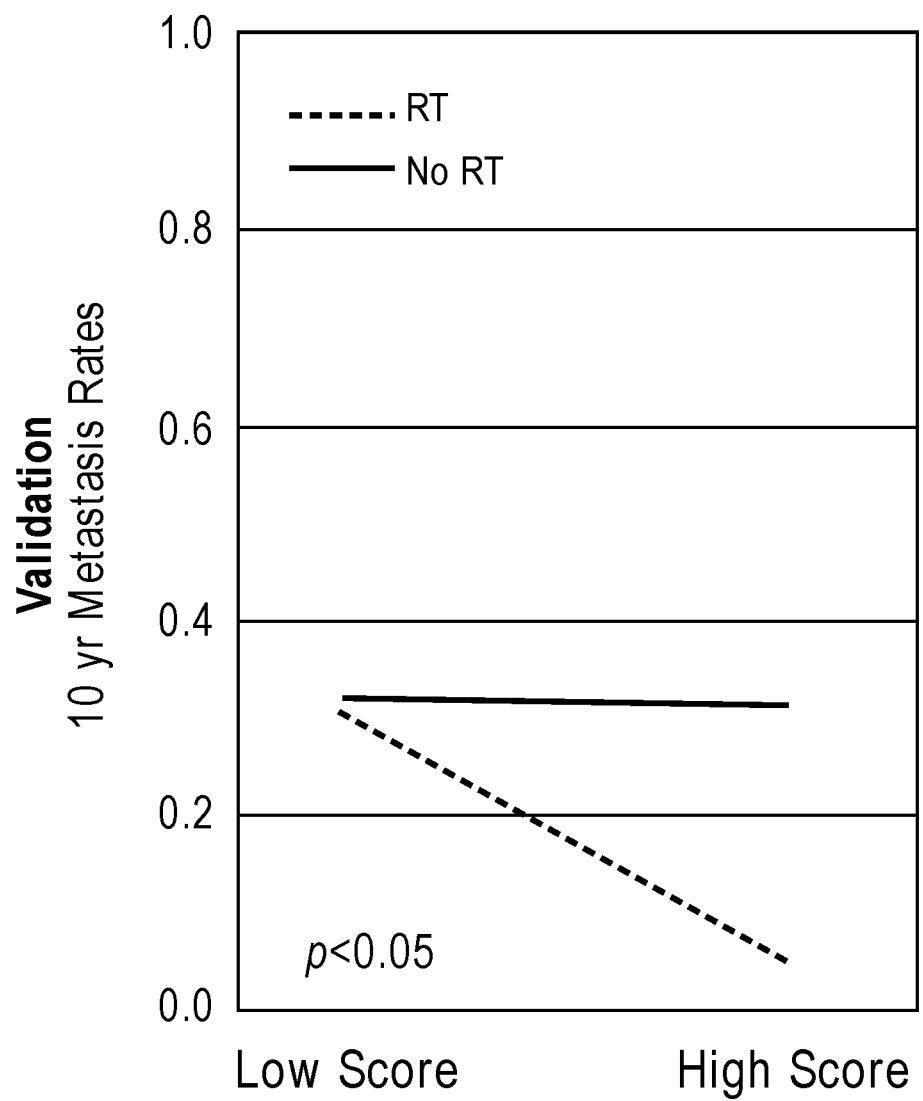
Figure 1D:
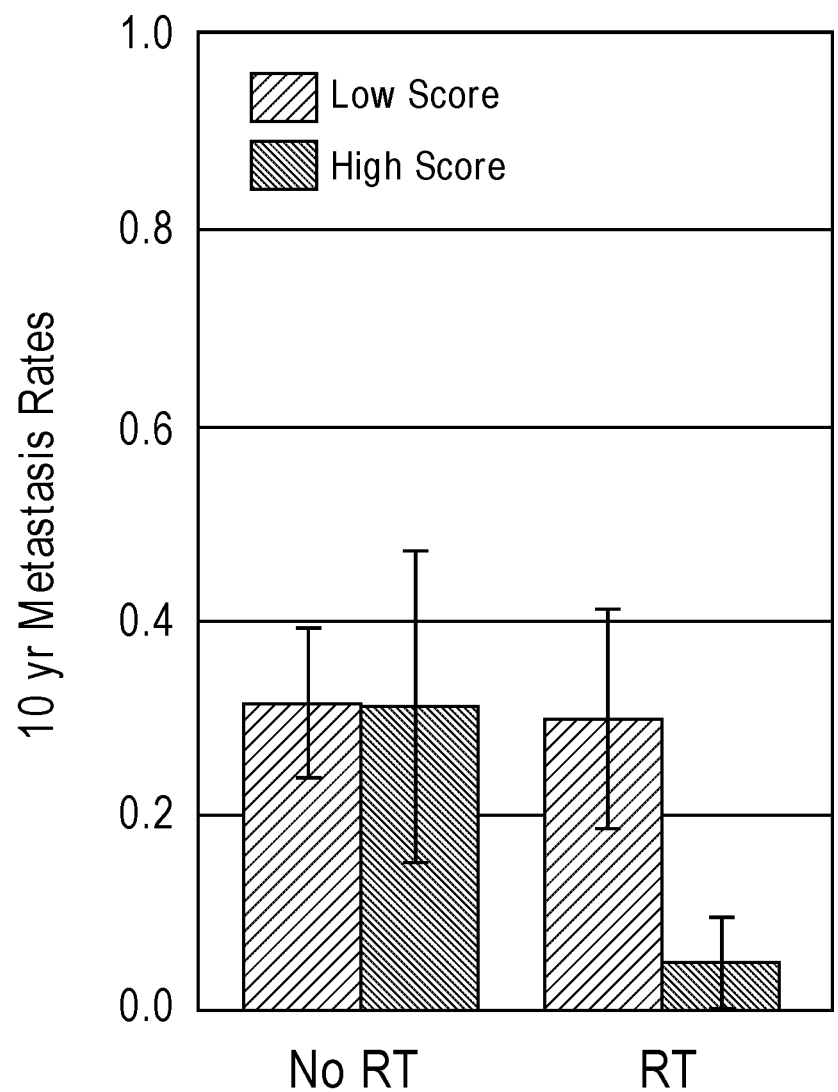
Figure 2C:
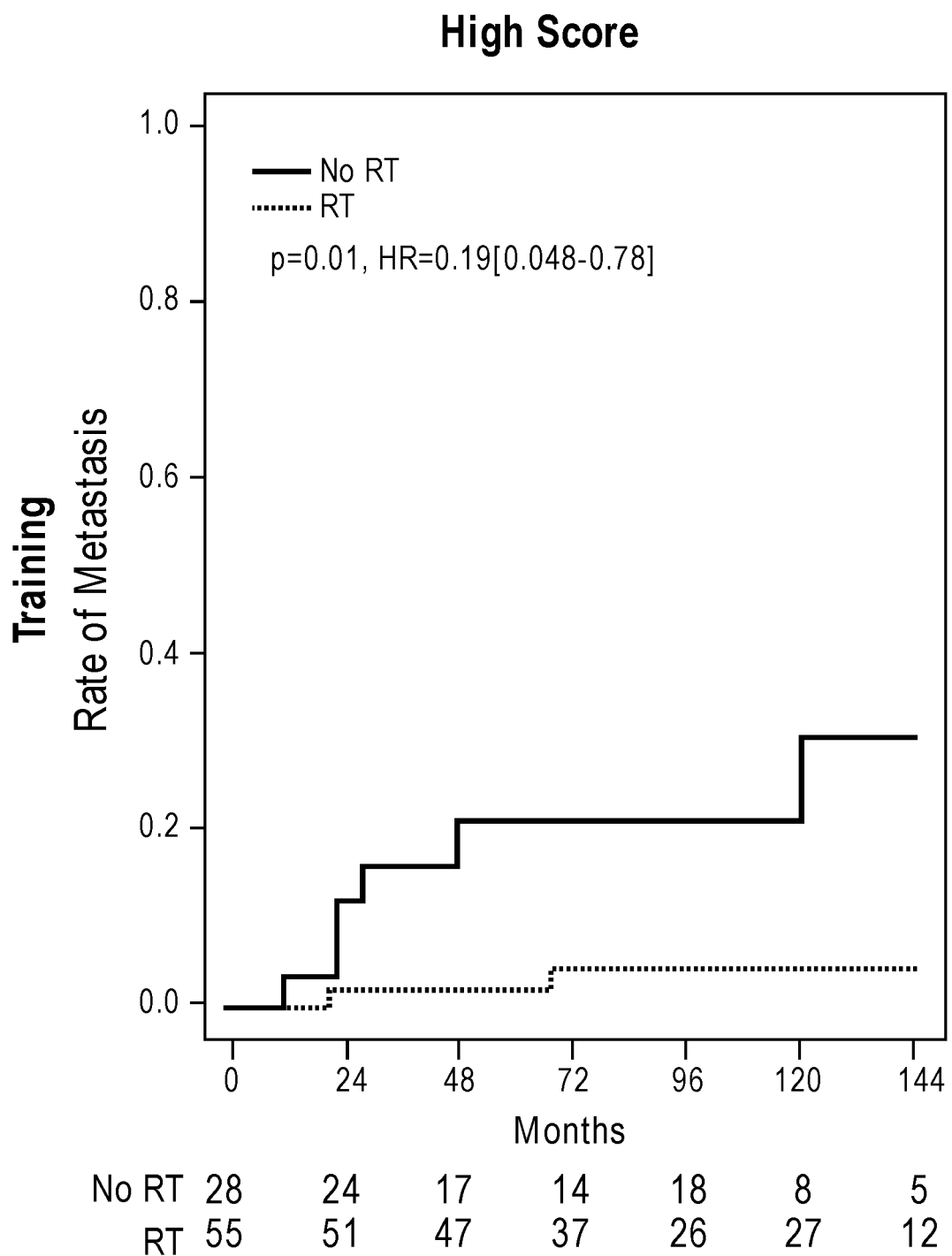
Figure 2D:
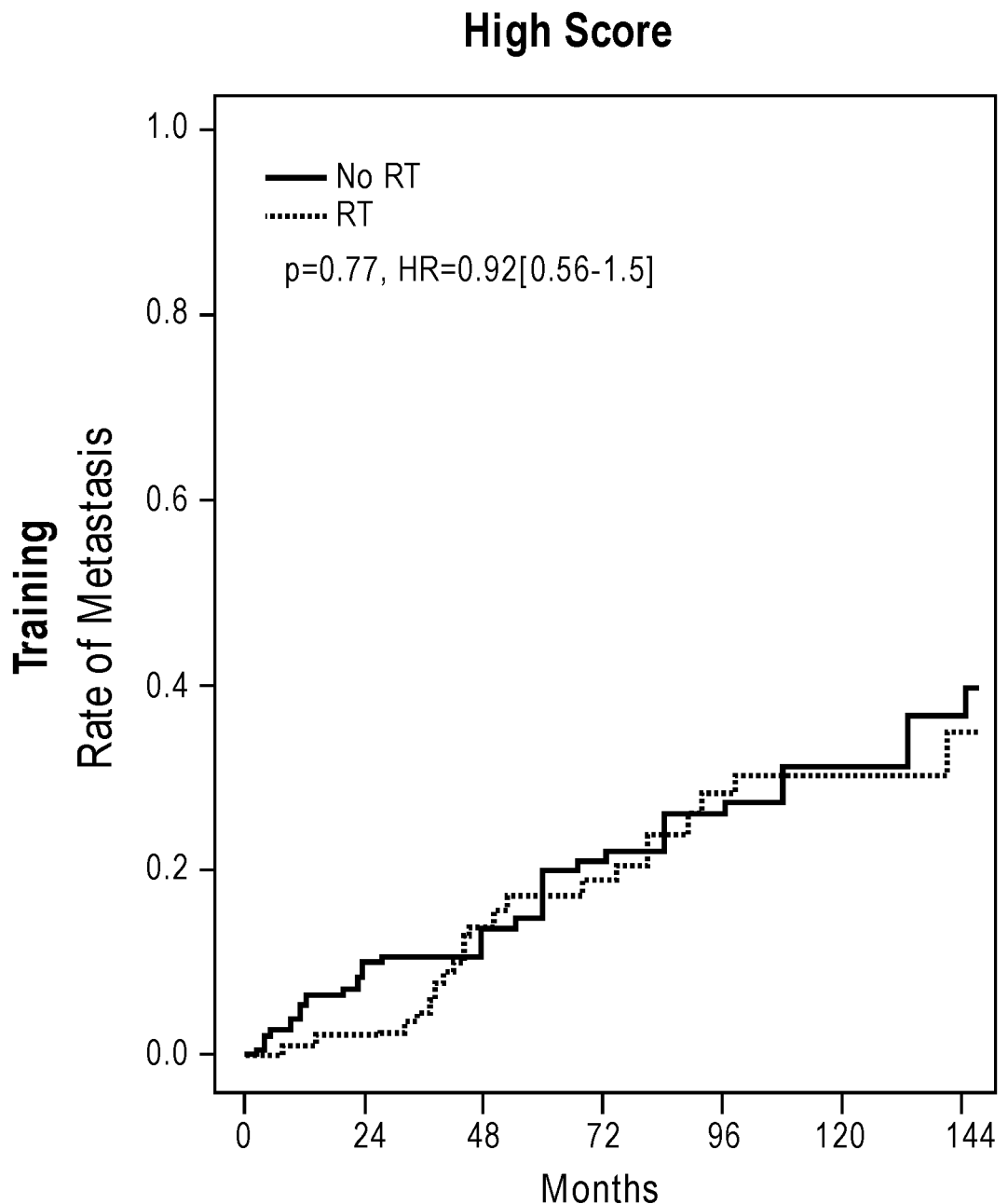

Example 3: PORTOS is Predictive of Response to Radiation Therapy in an Independent Validation of the Model To independently validate the model, a matched cohort of treated and untreated radiation therapy (RT) patients was designed using a pooled cohort from four clinical sites (MCII, THU, TJU and DVA). These results were confirmed in an independent matched validation cohort, with a significant interaction term (p<0.05, FIG. 1C). Within the high PORTOS group, patients treated with RT had better outcomes than untreated patients (p=0.01, HR=0.19 [0.048-0.78], FIG. 2C), with a 10-year metastasis rate of 4% in RT treated patients and 31% in untreated patients (FIG. 1D). Within the low PORTOS group, untreated patients had outcomes similar as treated patients (p=0.77, HR=0.92 [0.56-1.5], FIG. 2D) with 10-year metastasis rate of 31% in RT treated patients and 32% in untreated patients (FIG. 1D).

These results provide further evidence that patients with high scores are more likely to benefit from radiation treatment after surgery. These results showed that the PORTOS was useful for predicting benefit from post-operative RT in patients with prostate cancer. These results further indicated that methods of the present invention are useful for predicting response to post-operative radiation therapy and treating a subject for prostate cancer.

Example 4: PORTOS is an Independent Predictor of Response to Radiation Therapy after Adjusting for Clinical Variables To determine whether PORTOS is predictive, multivariable interaction analyses (MVA) to examine the interaction between PORTOS scores and RT treatment in a pooled set from multiple cohorts from different institutes was performed [Table 3]. Due to the differences in the baseline risks of cohorts, MVA adjusting was performed for clinical variables and institute. PORTOS was significantly interacting with RT (p<0.05).

These results provide further evidence that patients with high scores are more likely to benefit from radiation treatment after surgery. These results showed that the PORTOS was useful for predicting benefit from post-operative RT in patients with prostate cancer. These results further indicated that methods of the present invention are useful for predicting response to post-operative radiation therapy and treating a subject for prostate cancer.

TABLE 3

MVA of PORTOS adjusted for clinical variables to predict response to RT

| Covariate | | P-value | HR [95% CI] |
|---|---|---|---|
| RT | | 0.00411 | 2.49 [1.34-4.65] |
| PORTOS | | 8.26E−07 | 0.36 [0.24-0.54] |
| PSA | <10 | Reference | |
| | 10-20 | 0.179 | 0.8 [0.58-1.11] |
| | >20 | 0.547 | 1.13 [0.76-1.68] |
| Gleason | <7 | Reference | |
| | 7 | 0.134 | 4.57 [0.63-33.39] |
| | 8-10 | 0.0166 | 11.38 [1.56-83.3] |
| SMS | | 0.787 | 1.04 [0.77-1.41] |
| SVI | | 4.37E−05 | 1.89 [1.39-2.56] |
| ECE | | 0.269 | 1.22 [0.86-1.74] |
| LNI | | 0.00226 | 1.69 [1.21-2.36] |
| ADT | | 0.0102 | 2.13 [1.2-3.8] |
| Study | DVA | Reference | |
| | JHMI | 9.86E−06 | 11.6 [3.91-34.41] |
| | Mayo Val | 0.000273 | 6.32 [2.34-17.04] |
| | TJU | 0.535 | 1.5 [0.42-5.43] |
| RT: PORTOS | | 0.0203 | 2.74 [1.17-6.41] |

Example 5: Univariate and Pairwise Analysis of the 24 Target Genes in the Genetic Signature to Predict Post-Operative Radiation Therapy Response in Prostate Cancer Patients Across Different Endpoints The 24 targets in the genetic signature described in Example 1 were assessed for their performance across a range of different metrics and endpoints in both the training and validation cohorts.

Table 4 shows univariate (UVA) and pairwise (MVA) analysis of the interaction between RT treatment and individual genes in the genetic signature in Example 1. Table 5 shows univariate (UVA) and pairwise (MVA) analysis of the interaction between pairwise combinations of genes in the genetic signature and radiation therapy (RT) treatment adjusted for clinical variables. The associated p-value provided in Table 4 and 5 gives a measure of the statistical significance of the corresponding metric.

As shown in Tables 4 and 5, the performance of the 24 genes in the genetic signature, individually and as pairwise combinations, were statistically significant in the training and validation cohorts for predicting response to RT treatment. These results showed that the targets of the present invention are useful for predicting benefit from post-operative RT in patients with prostate cancer. These results also indicated that the methods of the present invention are useful for treating prostate cancer. These results further indicated that methods of the present invention are useful for predicting response to post-operative radiation therapy and treating a subject for prostate cancer.

TABLE 4

Univariate and Multivariate Analysis of the 24 Target Genes from the Genetic Signature with Associated P-values.

| Gene | UVA p-value of interaction of treatment and gene in Training Cohort | UVA p-value of interaction of treatment and gene in Validation Cohort | MVA p-value of interaction of treatment and gene adjusting for clinical variables Pooled in Validation Cohort |
|---|---|---|---|
| DRAM1 | 0.001 | 0.361 | 0.524 |
| KRT14 | 0.001 | 0.549 | 0.046 |
| PTPN22 | 0.005 | 0.407 | 0.004 |
| ZMAT3 | 0.012 | 0.275 | 0.927 |
| ARHGAP15 | 0.013 | 0.478 | 0.178 |
| IL1B | 0.013 | 0.611 | 0.891 |
| ANLN | 0.020 | 0.492 | 0.008 |
| RPS27A | 0.021 | 0.386 | 0.228 |
| MUM1 | 0.029 | 0.833 | 0.530 |
| TOP2A | 0.032 | 0.083 | 0.239 |
| GNG11 | 0.035 | 0.171 | 0.251 |
| CDKN3 | 0.036 | 0.691 | 0.087 |
| HCLS1 | 0.042 | 0.778 | 0.797 |
| DTL | 0.047 | 0.607 | 0.012 |
| IL7R | 0.050 | 0.829 | 0.076 |
| UBA7 | 0.050 | 0.905 | 0.435 |
| NEK1 | 0.053 | 0.506 | 0.893 |
| CDKN2AIP | 0.057 | 0.589 | 0.323 |
| APEX2 | 0.059 | 0.644 | 0.703 |
| KIF23 | 0.059 | 0.437 | 0.154 |
| SULF2 | 0.061 | 0.173 | 0.178 |
| PLK2 | 0.065 | 0.231 | 0.242 |
| EME1 | 0.067 | 0.031 | 0.006 |
| BIN2 | 0.071 | 0.009 | 0.000 |

TABLE 5

Univariable and Multivariable Analysis of pairwise combinations of the 24 Genes from the Genetic Signature with Associated P-values.

| Gene 1 | Gene 2 | UVA p-value of interaction of treatment and Genes 1 and 2 in Training Cohort | UVA p-value of interaction of treatment and Genes 1 and 2 in Validation Cohort | MVA p-value of interaction of treatment and genes 1 and 2 adjusting for clinical variables in Pooled Validation Cohort |
|---|---|---|---|---|
| DRAM1 | KRT14 | 0.000 | 0.596 | 0.058 |
| DRAM1 | PTPN22 | 0.002 | 0.370 | 0.014 |
| DRAM1 | ZMAT3 | 0.655 | 0.081 | 0.667 |
| DRAM1 | ARHGAP15 | 0.005 | 0.448 | 0.705 |
| DRAM1 | IL1B | 0.007 | 0.601 | 0.807 |
| DRAM1 | ANLN | 0.006 | 0.370 | 0.115 |

TABLE 5-continued

Univariate and Multivariable Analysis of pairwise combinations of the 24 Genes from the Genetic Signature with Associated P-values.

| Gene 1 | Gene 2 | UVA p-value of interaction of treatment and Genes 1 and 2 in Training Cohort | UVA p-value of interaction of treatment and Genes 1 and 2 in Validation Cohort | MVA p-value of interaction of treatment and genes 1 and 2 adjusting for clinical variables in Pooled Validation Cohort |
|---|---|---|---|---|
| DRAM1 | RPS27A | 0.001 | 0.190 | 0.663 |
| DRAM1 | MUM1 | 0.002 | 0.979 | 0.315 |
| DRAM1 | TOP2A | 0.044 | 0.075 | 0.911 |
| DRAM1 | GNG11 | 0.007 | 0.220 | 0.363 |
| DRAM1 | CDKN3 | 0.016 | 0.807 | 0.163 |
| DRAM1 | HCLS1 | 0.001 | 0.393 | 0.911 |
| DRAM1 | DTL | 0.015 | 0.687 | 0.028 |
| DRAM1 | IL7R | 0.434 | 0.994 | 0.120 |
| DRAM1 | UBA7 | 0.452 | 0.787 | 0.751 |
| DRAM1 | NEK1 | 0.031 | 0.568 | 0.449 |
| DRAM1 | CDKN2AIP | 0.019 | 0.516 | 0.198 |
| DRAM1 | APEX2 | 0.017 | 0.487 | 0.249 |
| DRAM1 | KIF23 | 0.148 | 0.527 | 0.542 |
| DRAM1 | SULF2 | 0.008 | 0.333 | 0.368 |
| DRAM1 | PLK2 | 0.039 | 0.267 | 0.041 |
| DRAM1 | EME1 | 0.033 | 0.041 | 0.018 |
| DRAM1 | BIN2 | 0.298 | 0.015 | 0.000 |
| KRT14 | PTPN22 | 0.000 | 0.882 | 0.838 |
| KRT14 | ZMAT3 | 0.002 | 0.602 | 0.055 |
| KRT14 | ARHGAP15 | 0.000 | 0.967 | 0.196 |
| KRT14 | IL1B | 0.000 | 0.664 | 0.287 |
| KRT14 | ANLN | 0.000 | 0.357 | 0.276 |
| KRT14 | RPS27A | 0.000 | 0.688 | 0.087 |
| KRT14 | MUM1 | 0.000 | 0.616 | 0.131 |
| KRT14 | TOP2A | 0.844 | 0.360 | 0.456 |
| KRT14 | GNG11 | 0.000 | 0.363 | 0.041 |
| KRT14 | CDKN3 | 0.000 | 0.312 | 0.248 |
| KRT14 | HCLS1 | 0.001 | 0.547 | 0.055 |
| KRT14 | DTL | 0.000 | 0.506 | 0.009 |
| KRT14 | IL7R | 0.004 | 0.435 | 0.023 |
| KRT14 | UBA7 | 0.002 | 0.507 | 0.054 |
| KRT14 | NEK1 | 0.000 | 0.520 | 0.343 |
| KRT14 | CDKN2AIP | 0.000 | 0.832 | 0.271 |
| KRT14 | APEX2 | 0.000 | 0.719 | 0.142 |
| KRT14 | KIF23 | 0.074 | 0.314 | 0.046 |
| KRT14 | SULF2 | 0.000 | 0.368 | 0.039 |
| KRT14 | PLK2 | 0.000 | 0.106 | 0.809 |
| KRT14 | EME1 | 0.000 | 0.035 | 0.003 |
| KRT14 | BIN2 | 0.011 | 0.133 | 0.003 |
| PTPN22 | ZMAT3 | 0.010 | 0.337 | 0.010 |
| PTPN22 | ARHGAP15 | 0.002 | 0.368 | 0.105 |
| PTPN22 | IL1B | 0.001 | 0.601 | 0.228 |
| PTPN22 | ANLN | 0.002 | 0.102 | 0.004 |
| PTPN22 | RPS27A | 0.001 | 0.312 | 0.007 |
| PTPN22 | MUM1 | 0.001 | 0.511 | 0.007 |
| PTPN22 | TOP2A | 0.363 | 0.071 | 0.252 |
| PTPN22 | GNG11 | 0.001 | 0.785 | 0.029 |
| PTPN22 | CDKN3 | 0.001 | 0.307 | 0.005 |
| PTPN22 | HCLS1 | 0.005 | 0.412 | 0.011 |
| PTPN22 | DTL | 0.000 | 0.721 | 0.610 |
| PTPN22 | IL7R | 0.020 | 0.502 | 0.022 |
| PTPN22 | UBA7 | 0.019 | 0.379 | 0.005 |
| PTPN22 | NEK1 | 0.003 | 0.842 | 0.016 |
| PTPN22 | CDKN2AIP | 0.001 | 0.304 | 0.003 |
| PTPN22 | APEX2 | 0.001 | 0.340 | 0.004 |
| PTPN22 | KIF23 | 0.281 | 0.851 | 0.080 |
| PTPN22 | SULF2 | 0.002 | 0.819 | 0.041 |
| PTPN22 | PLK2 | 0.003 | 0.601 | 0.003 |
| PTPN22 | EME1 | 0.001 | 0.207 | 0.989 |
| PTPN22 | BIN2 | 0.040 | 0.610 | 0.304 |
| ZMAT3 | ARHGAP15 | 0.027 | 0.409 | 0.706 |
| ZMAT3 | IL1B | 0.022 | 0.529 | 0.795 |
| ZMAT3 | ANLN | 0.042 | 0.495 | 0.153 |
| ZMAT3 | RPS27A | 0.142 | 0.338 | 0.817 |
| ZMAT3 | MUM1 | 0.176 | 0.857 | 0.377 |
| ZMAT3 | TOP2A | 0.023 | 0.085 | 0.967 |
| ZMAT3 | GNG11 | 0.136 | 0.280 | 0.379 |
| ZMAT3 | CDKN3 | 0.073 | 0.729 | 0.171 |
| ZMAT3 | HCLS1 | 0.021 | 0.289 | 0.558 |

TABLE 5-continued

Univariate and Multivariable Analysis of pairwise combinations of the 24 Genes from the Genetic Signature with Associated P-values.

| Gene 1 | Gene 2 | UVA p-value of interaction of treatment and Genes 1 and 2 in Training Cohort | UVA p-value of interaction of treatment and Genes 1 and 2 in Validation Cohort | MVA p-value of interaction of treatment and genes 1 and 2 adjusting for clinical variables in Pooled Validation Cohort |
|---|---|---|---|---|
| ZMAT3 | DTL | 0.117 | 0.659 | 0.023 |
| ZMAT3 | IL7R | 0.013 | 0.982 | 0.185 |
| ZMAT3 | UBA7 | 0.017 | 0.917 | 0.906 |
| ZMAT3 | NEK1 | 0.101 | 0.575 | 0.521 |
| ZMAT3 | CDKN2AIP | 0.145 | 0.503 | 0.252 |
| ZMAT3 | APEX2 | 0.156 | 0.600 | 0.326 |
| ZMAT3 | KIF23 | 0.033 | 0.562 | 0.516 |
| ZMAT3 | SULF2 | 0.401 | 0.331 | 0.207 |
| ZMAT3 | PLK2 | 0.097 | 0.237 | 0.036 |
| ZMAT3 | EME1 | 0.118 | 0.038 | 0.014 |
| ZMAT3 | BIN2 | 0.023 | 0.020 | 0.001 |
| ARHGAP15 | IL1B | 0.002 | 0.509 | 0.717 |
| ARHGAP15 | ANLN | 0.005 | 0.259 | 0.274 |
| ARHGAP15 | RPS27A | 0.001 | 0.370 | 0.525 |
| ARHGAP15 | MUM1 | 0.002 | 0.508 | 0.415 |
| ARHGAP15 | TOP2A | 0.327 | 0.052 | 0.566 |
| ARHGAP15 | GNG11 | 0.001 | 0.847 | 0.965 |
| ARHGAP15 | CDKN3 | 0.004 | 0.523 | 0.320 |
| ARHGAP15 | HCLS1 | 0.012 | 0.482 | 0.692 |
| ARHGAP15 | DTL | 0.001 | 0.559 | 0.340 |
| ARHGAP15 | IL7R | 0.059 | 0.468 | 0.835 |
| ARHGAP15 | UBA7 | 0.048 | 0.480 | 0.566 |
| ARHGAP15 | NEK1 | 0.004 | 0.748 | 0.327 |
| ARHGAP15 | CDKN2AIP | 0.002 | 0.341 | 0.244 |
| ARHGAP15 | APEX2 | 0.000 | 0.314 | 0.305 |
| ARHGAP15 | KIF23 | 0.475 | 0.722 | 0.988 |
| ARHGAP15 | SULF2 | 0.006 | 0.767 | 0.898 |
| ARHGAP15 | PLK2 | 0.006 | 0.577 | 0.069 |
| ARHGAP15 | EME1 | 0.001 | 0.329 | 0.180 |
| ARHGAP15 | BIN2 | 0.142 | 0.793 | 0.232 |
| IL1B | ANLN | 0.004 | 0.847 | 0.813 |
| IL1B | RPS27A | 0.003 | 0.508 | 0.637 |
| IL1B | MUM1 | 0.004 | 0.605 | 0.531 |
| IL1B | TOP2A | 0.940 | 0.064 | 0.347 |
| IL1B | GNG11 | 0.002 | 0.912 | 0.992 |
| IL1B | CDKN3 | 0.004 | 0.732 | 0.727 |
| IL1B | HCLS1 | 0.013 | 0.613 | 0.782 |
| IL1B | DTL | 0.001 | 0.475 | 0.807 |
| IL1B | IL7R | 0.032 | 0.666 | 0.932 |
| IL1B | UBA7 | 0.031 | 0.730 | 0.737 |
| IL1B | NEK1 | 0.005 | 0.751 | 0.403 |
| IL1B | CDKN2AIP | 0.003 | 0.537 | 0.329 |
| IL1B | APEX2 | 0.001 | 0.398 | 0.392 |
| IL1B | KIF23 | 0.103 | 0.764 | 0.936 |
| IL1B | SULF2 | 0.007 | 0.743 | 0.870 |
| IL1B | PLK2 | 0.004 | 0.422 | 0.200 |
| IL1B | EME1 | 0.001 | 0.385 | 0.444 |
| IL1B | BIN2 | 0.028 | 0.815 | 0.487 |
| ANLN | RPS27A | 0.003 | 0.530 | 0.142 |
| ANLN | MUM1 | 0.004 | 0.585 | 0.080 |
| ANLN | TOP2A | 0.346 | 0.061 | 0.587 |
| ANLN | GNG11 | 0.001 | 0.941 | 0.307 |
| ANLN | CDKN3 | 0.006 | 0.794 | 0.098 |
| ANLN | HCLS1 | 0.018 | 0.485 | 0.128 |
| ANLN | DTL | 0.000 | 0.864 | 0.693 |
| ANLN | IL7R | 0.103 | 0.868 | 0.663 |
| ANLN | UBA7 | 0.097 | 0.741 | 0.138 |
| ANLN | NEK1 | 0.012 | 0.785 | 0.234 |
| ANLN | CDKN2AIP | 0.006 | 0.860 | 0.132 |
| ANLN | APEX2 | 0.000 | 0.677 | 0.069 |
| ANLN | KIF23 | 0.431 | 0.860 | 0.060 |
| ANLN | SULF2 | 0.007 | 0.433 | 0.104 |
| ANLN | PLK2 | 0.009 | 0.733 | 0.018 |
| ANLN | EME1 | 0.001 | 0.108 | 0.334 |
| ANLN | BIN2 | 0.215 | 0.375 | 0.836 |
| RPS27A | MUM1 | 0.004 | 0.737 | 0.233 |
| RPS27A | TOP2A | 0.114 | 0.126 | 0.918 |
| RPS27A | GNG11 | 0.004 | 0.466 | 0.684 |
| RPS27A | CDKN3 | 0.004 | 0.918 | 0.118 |

TABLE 5-continued

Univariate and Multivariable Analysis of pairwise combinations of the 24 Genes from the Genetic Signature with Associated P-values.

| Gene 1 | Gene 2 | UVA p-value of interaction of treatment and Genes 1 and 2 in Training Cohort | UVA p-value of interaction of treatment and Genes 1 and 2 in Validation Cohort | MVA p-value of interaction of treatment and genes 1 and 2 adjusting for clinical variables in Pooled Validation Cohort |
|---|---|---|---|---|
| RPS27A | HCLS1 | 0.018 | 0.389 | 0.696 |
| RPS27A | DTL | 0.007 | 0.698 | 0.044 |
| RPS27A | IL7R | 0.430 | 0.879 | 0.498 |
| RPS27A | UBA7 | 0.527 | 0.541 | 0.577 |
| RPS27A | NEK1 | 0.016 | 0.659 | 0.394 |
| RPS27A | CDKN2AIP | 0.007 | 0.523 | 0.208 |
| RPS27A | APEX2 | 0.009 | 0.432 | 0.210 |
| RPS27A | KIF23 | 0.501 | 0.652 | 0.702 |
| RPS27A | SULF2 | 0.003 | 0.763 | 0.684 |
| RPS27A | PLK2 | 0.017 | 0.257 | 0.029 |
| RPS27A | EME1 | 0.013 | 0.063 | 0.028 |
| RPS27A | BIN2 | 0.976 | 0.024 | 0.007 |
| MUM1 | TOP2A | 0.036 | 0.063 | 0.751 |
| MUM1 | GNG11 | 0.005 | 0.221 | 0.828 |
| MUM1 | CDKN3 | 0.004 | 0.881 | 0.077 |
| MUM1 | HCLS1 | 0.025 | 0.829 | 0.284 |
| MUM1 | DTL | 0.010 | 0.808 | 0.137 |
| MUM1 | IL7R | 0.330 | 0.584 | 0.673 |
| MUM1 | UBA7 | 0.469 | 0.817 | 0.391 |
| MUM1 | NEK1 | 0.025 | 0.607 | 0.249 |
| MUM1 | CDKN2AIP | 0.007 | 0.621 | 0.096 |
| MUM1 | APEX2 | 0.011 | 0.796 | 0.152 |
| MUM1 | KIF23 | 0.449 | 0.474 | 0.997 |
| MUM1 | SULF2 | 0.001 | 0.248 | 0.792 |
| MUM1 | PLK2 | 0.015 | 0.257 | 0.023 |
| MUM1 | EME1 | 0.016 | 0.034 | 0.045 |
| MUM1 | BIN2 | 0.931 | 0.007 | 0.020 |
| TOP2A | GNG11 | 0.107 | 0.115 | 0.978 |
| TOP2A | CDKN3 | 0.419 | 0.089 | 0.681 |
| TOP2A | HCLS1 | 0.032 | 0.083 | 0.949 |
| TOP2A | DTL | 0.220 | 0.155 | 0.556 |
| TOP2A | IL7R | 0.026 | 0.189 | 0.737 |
| TOP2A | UBA7 | 0.021 | 0.085 | 0.966 |
| TOP2A | NEK1 | 0.546 | 0.112 | 0.752 |
| TOP2A | CDKN2AIP | 0.305 | 0.282 | 0.813 |
| TOP2A | APEX2 | 0.138 | 0.131 | 0.954 |
| TOP2A | KIF23 | 0.004 | 0.100 | 0.972 |
| TOP2A | SULF2 | 0.064 | 0.068 | 0.883 |
| TOP2A | PLK2 | 0.402 | 0.357 | 0.237 |
| TOP2A | EME1 | 0.413 | 0.278 | 0.632 |
| TOP2A | BIN2 | 0.013 | 0.390 | 0.542 |
| GNG11 | CDKN3 | 0.002 | 0.277 | 0.485 |
| GNG11 | HCLS1 | 0.032 | 0.166 | 0.375 |
| GNG11 | DTL | 0.009 | 0.544 | 0.035 |
| GNG11 | IL7R | 0.268 | 0.269 | 0.185 |
| GNG11 | UBA7 | 0.366 | 0.231 | 0.592 |
| GNG11 | NEK1 | 0.010 | 0.307 | 0.920 |
| GNG11 | CDKN2AIP | 0.002 | 0.755 | 0.670 |
| GNG11 | APEX2 | 0.011 | 0.528 | 0.878 |
| GNG11 | KIF23 | 0.772 | 0.197 | 0.369 |
| GNG11 | SULF2 | 0.007 | 0.038 | 0.179 |
| GNG11 | PLK2 | 0.007 | 0.120 | 0.063 |
| GNG11 | EME1 | 0.025 | 0.008 | 0.010 |
| GNG11 | BIN2 | 0.691 | 0.017 | 0.009 |
| CDKN3 | HCLS1 | 0.033 | 0.694 | 0.157 |
| CDKN3 | DTL | 0.004 | 0.509 | 0.428 |
| CDKN3 | IL7R | 0.159 | 0.312 | 0.664 |
| CDKN3 | UBA7 | 0.111 | 0.654 | 0.211 |
| CDKN3 | NEK1 | 0.020 | 0.561 | 0.237 |
| CDKN3 | CDKN2AIP | 0.016 | 0.787 | 0.087 |
| CDKN3 | APEX2 | 0.000 | 0.724 | 0.081 |
| CDKN3 | KIF23 | 0.469 | 0.340 | 0.446 |
| CDKN3 | SULF2 | 0.015 | 0.571 | 0.221 |
| CDKN3 | PLK2 | 0.012 | 0.321 | 0.024 |
| CDKN3 | EME1 | 0.002 | 0.018 | 0.251 |
| CDKN3 | BIN2 | 0.203 | 0.062 | 0.782 |
| HCLS1 | DTL | 0.044 | 0.605 | 0.028 |
| HCLS1 | IL7R | 0.054 | 0.828 | 0.175 |
| HCLS1 | UBA7 | 0.059 | 0.894 | 0.798 |

TABLE 5-continued

Univariate and Multivariable Analysis of pairwise combinations of the 24 Genes from the Genetic Signature with Associated P-values.

| Gene 1 | Gene 2 | UVA p-value of interaction of treatment and Genes 1 and 2 in Training Cohort | UVA p-value of interaction of treatment and Genes 1 and 2 in Validation Cohort | MVA p-value of interaction of treatment and genes 1 and 2 adjusting for clinical variables in Pooled Validation Cohort |
|---|---|---|---|---|
| HCLS1 | NEK1 | 0.050 | 0.500 | 0.467 |
| HCLS1 | CDKN2AIP | 0.051 | 0.596 | 0.207 |
| HCLS1 | APEX2 | 0.056 | 0.648 | 0.265 |
| HCLS1 | KIF23 | 0.065 | 0.437 | 0.537 |
| HCLS1 | SULF2 | 0.052 | 0.173 | 0.283 |
| HCLS1 | PLK2 | 0.063 | 0.230 | 0.038 |
| HCLS1 | EME1 | 0.065 | 0.032 | 0.016 |
| HCLS1 | BIN2 | 0.080 | 0.008 | 0.001 |
| DTL | IL7R | 0.210 | 0.407 | 0.005 |
| DTL | UBA7 | 0.211 | 0.596 | 0.026 |
| DTL | NEK1 | 0.015 | 0.102 | 0.151 |
| DTL | CDKN2AIP | 0.006 | 0.544 | 0.152 |
| DTL | APEX2 | 0.008 | 0.526 | 0.199 |
| DTL | KIF23 | 0.997 | 0.595 | 0.109 |
| DTL | SULF2 | 0.009 | 0.533 | 0.033 |
| DTL | PLK2 | 0.005 | 0.169 | 0.492 |
| DTL | EME1 | 0.012 | 0.063 | 0.004 |
| DTL | BIN2 | 0.413 | 0.299 | 0.001 |
| IL7R | UBA7 | 0.017 | 0.682 | 0.424 |
| IL7R | NEK1 | 0.127 | 0.486 | 0.839 |
| IL7R | CDKN2AIP | 0.302 | 0.661 | 0.648 |
| IL7R | APEX2 | 0.246 | 0.995 | 0.977 |
| IL7R | KIF23 | 0.011 | 0.347 | 0.187 |
| IL7R | SULF2 | 0.893 | 0.210 | 0.027 |
| IL7R | PLK2 | 0.158 | 0.170 | 0.091 |
| IL7R | EME1 | 0.150 | 0.020 | 0.003 |
| IL7R | BIN2 | 0.016 | 0.049 | 0.002 |
| UBA7 | NEK1 | 0.114 | 0.548 | 0.517 |
| UBA7 | CDKN2AIP | 0.283 | 0.701 | 0.248 |
| UBA7 | APEX2 | 0.318 | 0.704 | 0.267 |
| UBA7 | KIF23 | 0.030 | 0.342 | 0.650 |
| UBA7 | SULF2 | 0.934 | 0.139 | 0.552 |
| UBA7 | PLK2 | 0.141 | 0.263 | 0.032 |
| UBA7 | EME1 | 0.200 | 0.021 | 0.014 |
| UBA7 | BIN2 | 0.020 | 0.029 | 0.016 |
| NEK1 | CDKN2AIP | 0.025 | 0.868 | 0.255 |
| NEK1 | APEX2 | 0.003 | 0.690 | 0.303 |
| NEK1 | KIF23 | 0.638 | 0.471 | 0.637 |
| NEK1 | SULF2 | 0.018 | 0.271 | 0.619 |
| NEK1 | PLK2 | 0.004 | 0.122 | 0.017 |
| NEK1 | EME1 | 0.005 | 0.031 | 0.172 |
| NEK1 | BIN2 | 0.147 | 0.065 | 0.445 |
| CDKN2AIP | APEX2 | 0.002 | 0.553 | 0.110 |
| CDKN2AIP | KIF23 | 0.777 | 0.957 | 0.686 |
| CDKN2AIP | SULF2 | 0.016 | 0.947 | 0.417 |
| CDKN2AIP | PLK2 | 0.013 | 0.305 | 0.008 |
| CDKN2AIP | EME1 | 0.004 | 0.109 | 0.155 |
| CDKN2AIP | BIN2 | 0.465 | 0.381 | 0.377 |
| APEX2 | KIF23 | 0.992 | 0.656 | 0.809 |
| APEX2 | SULF2 | 0.010 | 0.911 | 0.510 |
| APEX2 | PLK2 | 0.010 | 0.246 | 0.013 |
| APEX2 | EME1 | 0.024 | 0.088 | 0.116 |
| APEX2 | BIN2 | 0.593 | 0.175 | 0.221 |
| KIF23 | SULF2 | 0.198 | 0.371 | 0.405 |
| KIF23 | PLK2 | 0.455 | 0.160 | 0.092 |
| KIF23 | EME1 | 0.587 | 0.059 | 0.031 |
| KIF23 | BIN2 | 0.032 | 0.041 | 0.023 |
| SULF2 | PLK2 | 0.036 | 0.163 | 0.070 |
| SULF2 | EME1 | 0.021 | 0.022 | 0.015 |
| SULF2 | BIN2 | 0.464 | 0.002 | 0.000 |
| PLK2 | EME1 | 0.006 | 0.018 | 0.642 |
| PLK2 | BIN2 | 0.249 | 0.072 | 0.291 |
| EME1 | BIN2 | 0.353 | 0.005 | 0.001 |

While the preferred embodiments of the invention have been illustrated and described, it will be appreciated that various changes can be made therein without departing from the spirit and scope of the invention.

SEQUENCE LISTING (2021 sequences)

SEQ ID NO: 1 - protein, 25 aa, Homo sapiens
AGATGCTGAAAAGAGAGTCGACTCC

SEQ ID NO: 2 - protein, 25 aa, Homo sapiens
CGGTTAGTCTCTCGCACTGCAGTCA

SEQ ID NO: 3 - protein, 25 aa, Homo sapiens
TCGACTCCGAAAAGGAGGCTGGGAC

SEQ ID NO: 4 - protein, 25 aa, Homo sapiens
CCTGCAGCGAGCCTTCGGTTAGTCT

SEQ ID NO: 5 - protein, 25 aa, Homo sapiens
GGAGGAAAACCTACATGGAAGAGAA

SEQ ID NO: 6 - protein, 25 aa, Homo sapiens
AGTCACGTCACCATTACTACTTGTG

SEQ ID NO: 7 - protein, 25 aa, Homo sapiens
CCTCTTTGTCCTCAGGGTCAAGGAG

SEQ ID NO: 8 - protein, 25 aa, Homo sapiens
ACTTGTGTGAAGAATACCTCTTTGT

SEQ ID NO: 9 - protein, 25 aa, Homo sapiens
AACAAGCTAACATATTGTGTCTTAG

SEQ ID NO: 10 - protein, 25 aa, Homo sapiens
ACCTTGTACATGATCGTCAACGGTT

SEQ ID NO: 11 - protein, 25 aa, Homo sapiens
GAGGGTTATACCTTGTACATGATCG

SEQ ID NO: 12 - protein, 25 aa, Homo sapiens
CGTCAACGGTTACTTCTTCCGAAAC

SEQ ID NO: 13 - protein, 25 aa, Homo sapiens
GTGACCTTACGGCAGAAACTGGACC

SEQ ID NO: 14 - protein, 25 aa, Homo sapiens
TACCTACCGAGTGACCTTACGGCAG

SEQ ID NO: 15 - protein, 25 aa, Homo sapiens
ACCTTACGGCAGAAACTGGACCGGA

SEQ ID NO: 16 - protein, 25 aa, Homo sapiens
ACCGAGTGACCTTACGGCAGAAACT

SEQ ID NO: 17 - protein, 25 aa, Homo sapiens
TCGGAGTTCAGTCAACGGAAAAGAT

SEQ ID NO: 18 - protein, 25 aa, Homo sapiens
TACGTTTCCAGTAGTTACGTCGGAG

SEQ ID NO: 19 - protein, 25 aa, Homo sapiens
CCTGCATTTTCGACCACTCGACTAA

SEQ ID NO: 20 - protein, 25 aa, Homo sapiens
ACCTTGTACGTTTCCAGTAGTTACG

SEQ ID NO: 21 - protein, 25 aa, Homo sapiens
CCGTTGTAATACCAGACCCTATGGT

SEQ ID NO: 22 - DNA, 25 bp, Homo sapiens
accgttgtaataccagaccctatgg

SEQ ID NO: 23 - protein, 25 aa, Homo sapiens
TACCGTTGTAATACCAGACCCTATG

SEQ ID NO: 24 - protein, 25 aa, Homo sapiens
CGTTGTAATACCAGACCCTATGGTC

SEQ ID NO: 25 - protein, 25 aa, Homo sapiens
TTATGGAGTCTGTTCGTTTGGGGAA

SEQ ID NO: 26 - protein, 25 aa, Homo sapiens
GTTCACTTAGTTTAGTCACCTCGAG

SEQ ID NO: 27 - protein, 25 aa, Homo sapiens
ATATCCGTTCACTTAGTTTAGTCAC

SEQ ID NO: 28 - protein, 25 aa, Homo sapiens
GTTTAGTCACCTCGAGTGTTATGGA

SEQ ID NO: 29 - protein, 25 aa, Homo sapiens
CACCAGGAGAAAGTTCTGCTCTTAT

SEQ ID NO: 30 - protein, 25 aa, Homo sapiens
CTTATGGAATCAGAGTCGTCCTCGA

SEQ ID NO: 31 - protein, 25 aa, Homo sapiens
GGAGAAAGTTCTGCTCTTATGGAAT

SEQ ID NO: 32 - protein, 25 aa, Homo sapiens
AAGGTCGTTTCACAATGACACCAGG

SEQ ID NO: 33 - protein, 25 aa, Homo sapiens
AGATGAAATAAACGATTAACGTGTC

SEQ ID NO: 34 - protein, 25 aa, Homo sapiens
AACGTGTCTGCTATTGTAGATGTAC

SEQ ID NO: 35 - protein, 25 aa, Homo sapiens
CTATAAGTTCAGACTAAAACCTAAG

SEQ ID NO: 36 - protein, 25 aa, Homo sapiens
GTAGATGTACAAATTATACTGACCC

SEQ ID NO: 37 - protein, 25 aa, Homo sapiens
ATACATTTTAGGTCGGAATCAGGTC

SEQ ID NO: 38 - protein, 25 aa, Homo sapiens
TCAAAAATCAGTCACCGAGTTCACT

SEQ ID NO: 39 - protein, 25 aa, Homo sapiens
TTAGGTCGGAATCAGGTCTACTGGT

SEQ ID NO: 40 - protein, 25 aa, Homo sapiens
ACCGATAAAAGTTACCTGTGGTCTT

SEQ ID NO: 41 - protein, 25 aa, Homo sapiens
CGACCACAGGTAGACTGAAGTGTTT

SEQ ID NO: 42 - protein, 25 aa, Homo sapiens
CCAGTAAGAGTTCTCCAGTGCAGAC

SEQ ID NO: 43 - protein, 25 aa, Homo sapiens
GTGGGACCGTTGGAGGATGACACGA

SEQ ID NO: 44 - protein, 25 aa, Homo sapiens
AGGTGTGGGACCGTTGGAGGATGAC

SEQ ID NO: 45 - protein, 25 aa, Homo sapiens
TATTAATAGGTCAGTGTTCCGGAAT

SEQ ID NO: 46 - protein, 25 aa, Homo sapiens
CTCAGTCGAAACAACCTTTAGACCT

SEQ ID NO: 47 - protein, 25 aa, Homo sapiens
AGATATAGGACAAATAATCTGTTTT

SEQ ID NO: 48 - protein, 25 aa, Homo sapiens
TGTTCCGGAATTCTGTGTGGACAAA

SEQ ID NO: 49 - protein, 25 aa, Homo sapiens
GACCGCGAACTTATCTCCGAATCTC

SEQ ID NO: 50 - protein, 25 aa, Homo sapiens
TTAGACCGCGAACTTATCTCCGAAT

SEQ ID NO: 51 - protein, 25 aa, Homo sapiens
GCGAACTTATCTCCGAATCTCCTCT

SEQ ID NO: 52 - protein, 25 aa, Homo sapiens
TTTTTAGACCGCGAACTTATCTCCG

SEQ ID NO: 53 - protein, 25 aa, Homo sapiens
AGTCTTTCGACACCTTGCGATGGAG

SEQ ID NO: 54 - protein, 25 aa, Homo sapiens
ACACGACGGAACGACCATTGGTCCT

SEQ ID NO: 55 - protein, 25 aa, Homo sapiens
ACACGACGGAACGACCATTGGTCCT

SEQ ID NO: 56 - protein, 25 aa, Homo sapiens
CAGAGGATAGTCAGGCATACGAAGT

SEQ ID NO: 57 - protein, 25 aa, Homo sapiens
GTATGAAGGTATCTTTCAGGGTCCT

SEQ ID NO: 58 - protein, 25 aa, Homo sapiens
GACGTGTATGAAGGTATCTTTCAGG

SEQ ID NO: 59 - protein, 25 aa, Homo sapiens
AAGACACCAGGACTTGTGAGTTGTC

SEQ ID NO: 60 - protein, 25 aa, Homo sapiens
AGGACTTGTGAGTTGTCTTAATATC

SEQ ID NO: 61 - protein, 25 aa, Homo sapiens
ACCCACGGTTTCCAGTTGACATTAC

SEQ ID NO: 62 - protein, 25 aa, Homo sapiens
GGGACTCCTGACACATCTGAAATAC

SEQ ID NO: 63 - protein, 25 aa, Homo sapiens
AAGTCCACGTCAGTAGTCAAGAAAT

SEQ ID NO: 64 - protein, 25 aa, Homo sapiens
GACCCATATTGTACAGAGTGAACCT

SEQ ID NO: 65 - protein, 25 aa, Homo sapiens
AGATGTTTTTTCTTGATATCATCAG

SEQ ID NO: 66 - protein, 25 aa, Homo sapiens
ACTCGAAAAACGTAATGGATCTTCG

SEQ ID NO: 67 - protein, 25 aa, Homo sapiens
CGTAATGGATCTTCGTCAGATGTTT

SEQ ID NO: 68 - protein, 25 aa, Homo sapiens
TCGAAAAACGTAATGGATCTTCGTC

SEQ ID NO: 69 - protein, 25 aa, Homo sapiens
ACGTCAGACGTTTCCAGAAGTGTTT

SEQ ID NO: 70 - protein, 25 aa, Homo sapiens
AAAACGGATTTACCTCATATGGAAC

SEQ ID NO: 71 - protein, 25 aa, Homo sapiens
CATGTTACATAGGTTGTCTGTGAGT

SEQ ID NO: 72 - protein, 25 aa, Homo sapiens
TAAGGGACTGTCAATAAAAACGGAT

SEQ ID NO: 73 - protein, 25 aa, Homo sapiens
CCCAACGTTATGTTTGACGAGAACT

SEQ ID NO: 74 - protein, 25 aa, Homo sapiens
ATTCACGGTCAAAACGTAAAAGTAT

SEQ ID NO: 75 - protein, 25 aa, Homo sapiens
CGTTTTACGGTTATTCACGGTCAAA

SEQ ID NO: 76 - protein, 25 aa, Homo sapiens
TACTTCTATACGATTACACAATTAT

SEQ ID NO: 77 - protein, 25 aa, Homo sapiens
ATTCACGAGATATACGTATTATAGT

SEQ ID NO: 78 - protein, 25 aa, Homo sapiens
TCCTTAGGTGGTGGTTGAACCTTAT

SEQ ID NO: 79 - protein, 25 aa, Homo sapiens
GTTCCTTAGGTGGTGGTTGAACCTT

SEQ ID NO: 80 - protein, 25 aa, Homo sapiens
CTTAGGTGGTGGTTGAACCTTATAA

SEQ ID NO: 81 - protein, 25 aa, Homo sapiens
GGTTCCTTAGGTGGTGGTTGAACCT

SEQ ID NO: 82 - protein, 25 aa, Homo sapiens
AAGAACGGGTGGTTTGTTCGGACGT

SEQ ID NO: 83 - protein, 25 aa, Homo sapiens
ACAAGTCAGTTTATTGAGGTCGAGT

SEQ ID NO: 84 - protein, 25 aa, Homo sapiens
AGTTTATTGAGGTCGAGTAAAGACT

SEQ ID NO: 85 - protein, 25 aa, Homo sapiens
GAACGGGTGGTTTGTTCGGACGTCT

SEQ ID NO: 86 - protein, 25 aa, Homo sapiens
AGACTCAGACAGAAATCAGAAAGGG

SEQ ID NO: 87 - protein, 25 aa, Homo sapiens
CACTAGACTAGTTGTCAGTAGACTC

SEQ ID NO: 88 - protein, 25 aa, Homo sapiens
GAATTGTTAATATACACTAGACTAG

SEQ ID NO: 89 - protein, 25 aa, Homo sapiens
CATTCGTGGATGTAAAACAATTGTA

SEQ ID NO: 90 - protein, 25 aa, Homo sapiens
ACTTCTGAGGACCTTTTTCAAAGTG

SEQ ID NO: 91 - protein, 25 aa, Homo sapiens
CTTCTGAGGACCTTTTTCAAAGTGT

SEQ ID NO: 92 - protein, 25 aa, Homo sapiens
TCTGAGGACCTTTTTCAAAGTGTTC

SEQ ID NO: 93 - protein, 25 aa, Homo sapiens
GACTTCTGAGGACCTTTTTCAAAGT

SEQ ID NO: 94 - protein, 25 aa, Homo sapiens
ATAAAGACCGAAAGGGTCTGATCTT

SEQ ID NO: 95 - protein, 25 aa, Homo sapiens
CAATTCAAATCTCATTAAGTGAAGT

SEQ ID NO: 96 - protein, 25 aa, Homo sapiens
AGTGAAGTCCTTCAATGAACCAAGG

SEQ ID NO: 97 - protein, 25 aa, Homo sapiens
CCAAGGGTATTATCGAAGGTCATAA

SEQ ID NO: 98 - protein, 25 aa, Homo sapiens
ACATTTTGAGGCTTCAGGATTTAGT

SEQ ID NO: 99 - protein, 25 aa, Homo sapiens
CTTCCATTTTTAACCTTGTAGTGAC

SEQ ID NO: 100 - protein, 25 aa, Homo sapiens
ACTACTGAGACACTATGAATCTGGT

SEQ ID NO: 101 - protein, 25 aa, Homo sapiens
ACCCCACCTTGTAGACTTGGTTTCT

SEQ ID NO: 102 - protein, 25 aa, Homo sapiens
GAGACACTATGAATCTGGTTCGTTC

SEQ ID NO: 103 - protein, 25 aa, Homo sapiens
GGTGAAGGACATACCTGTGGACTTA

SEQ ID NO: 104 - protein, 25 aa, Homo sapiens
GGACTTAGTAAATAACACCAACTCC

SEQ ID NO: 105 - protein, 25 aa, Homo sapiens
GACATACCTGTGGACTTAGTAAATA

SEQ ID NO: 106 - protein, 25 aa, Homo sapiens
AAGGACATACCTGTGGACTTAGTAA

SEQ ID NO: 107 - protein, 25 aa, Homo sapiens
GGTACTGAGATCACGAGAACCACAT

SEQ ID NO: 108 - protein, 25 aa, Homo sapiens
TCTCGATCAAAACGTGGGACGATTT

SEQ ID NO: 109 - protein, 25 aa, Homo sapiens
AGTAGTACCGGAGGTTCACCATGGT

SEQ ID NO: 110 - protein, 25 aa, Homo sapiens
GGTTATCAACCCCTCGGAGAAGTCT

SEQ ID NO: 111 - protein, 25 aa, Homo sapiens
ATCTTGATAAATTCTCTGTCTACCT

SEQ ID NO: 112 - protein, 25 aa, Homo sapiens
TCTCTGTCTACCTACAATAGTCTCT

SEQ ID NO: 113 - protein, 25 aa, Homo sapiens
CCAGATGTTACGACATAATCTTGAT

SEQ ID NO: 114 - protein, 25 aa, Homo sapiens
ACTTGACCAGATGTTACGACATAAT

SEQ ID NO: 115 - protein, 25 aa, Homo sapiens
GTCTCCGGAAGTAATCAAGTTTGCG

SEQ ID NO: 116 - protein, 25 aa, Homo sapiens
CAAAAGTCAAACTAGGCCCTTTACG

SEQ ID NO: 117 - protein, 25 aa, Homo sapiens
CTCCGGAAGTAATCAAGTTTGCGTC

SEQ ID NO: 118 - protein, 25 aa, Homo sapiens
GCCCTTTACGCCTGTGTCTCCGGAA

SEQ ID NO: 119 - protein, 25 aa, Homo sapiens
ACGATAACTAATATGTACCTACAAC

SEQ ID NO: 120 - protein, 25 aa, Homo sapiens
AACTAATATGTACCTACAACGATTT

SEQ ID NO: 121 - protein, 25 aa, Homo sapiens
ACACGATAACTAATATGTACCTACA

SEQ ID NO: 122 - protein, 25 aa, Homo sapiens
GATAACTAATATGTACCTACAACGA

SEQ ID NO: 123 - protein, 25 aa, Homo sapiens
AGTAGACCCTACATGCAACAATGGT

SEQ ID NO: 124 - protein, 25 aa, Homo sapiens
CTACTGTCACAAGGGTATACGTAAG

SEQ ID NO: 125 - protein, 25 aa, Homo sapiens
ATATCTGGGATAAGAACTCGAGTAG

SEQ ID NO: 126 - protein, 25 aa, Homo sapiens
CTACATGGAAGTAGATATCTGGGAT

SEQ ID NO: 127 - protein, 25 aa, Homo sapiens
GACTAATATATTAGTCCTGAGATTT

SEQ ID NO: 128 - protein, 25 aa, Homo sapiens
CTAATATATTAGTCCTGAGATTTTC

SEQ ID NO: 129 - protein, 25 aa, Homo sapiens
ATATATTAGTCCTGAGATTTTCAAT

SEQ ID NO: 130 - protein, 25 aa, Homo sapiens
ATATTAGTCCTGAGATTTTCAATTC

SEQ ID NO: 131 - protein, 25 aa, Homo sapiens
ACAATACCGTACGTACCTCATACTT

SEQ ID NO: 132 - protein, 25 aa, Homo sapiens
ATACCGTACGTACCTCATACTTTAC

SEQ ID NO: 133 - protein, 25 aa, Homo sapiens
TACGTACCTCATACTTTACCCTTTC

SEQ ID NO: 134 - protein, 25 aa, Homo sapiens
AGTAACAATACCGTACGTACCTCAT

SEQ ID NO: 135 - protein, 25 aa, Homo sapiens
AGGGACTATTGGAGACTACTCCTAA

SEQ ID NO: 136 - protein, 25 aa, Homo sapiens
TATCGGCCCATCTTGATAGGGACTA

SEQ ID NO: 137 - protein, 25 aa, Homo sapiens
CTAATATCGGCCCATCTTGATAGGG

SEQ ID NO: 138 - protein, 25 aa, Homo sapiens
CTTGATAGGGACTATTGGAGACTAC

SEQ ID NO: 139 - protein, 25 aa, Homo sapiens
GATAGGATGTTGACACCGACTCTTC

SEQ ID NO: 140 - protein, 25 aa, Homo sapiens
CCGTCTGTTTTGGATAGGATGTTGA

SEQ ID NO: 141 - protein, 25 aa, Homo sapiens
GTTAGATGGTTCATGTTCCGTCTGT

SEQ ID NO: 142 - protein, 25 aa, Homo sapiens
TTTCCGTTAGATGGTTCATGTTCCG

SEQ ID NO: 143 - protein, 25 aa, Homo sapiens
TACCTGGTTTCTCTTTAAGACGTCT

SEQ ID NO: 144 - protein, 25 aa, Homo sapiens
TCTCCTCAAACGGTTACTTAAAGAC

SEQ ID NO: 145 - protein, 25 aa, Homo sapiens
TTAATGATTTCTCCTCAAACGGTTA

SEQ ID NO: 146 - protein, 25 aa, Homo sapiens
CTACTCCGGGTTTCGTTCTTTTAAT

SEQ ID NO: 147 - protein, 25 aa, Homo sapiens
CGCAGACCATCTAACGACTAAGAGA

SEQ ID NO: 148 - protein, 25 aa, Homo sapiens
CGGGTTCCTCGCAGACCATCTAACG

SEQ ID NO: 149 - protein, 25 aa, Homo sapiens
CCTCGCAGACCATCTAACGACTAAG

SEQ ID NO: 150 - protein, 25 aa, Homo sapiens
CGTCCCTCCGCGATGTCCTCTCTTT

SEQ ID NO: 151 - protein, 25 aa, Homo sapiens
ATCGGTGCAACTAACATGCCCTTTT

SEQ ID NO: 152 - protein, 25 aa, Homo sapiens
AAGAGAATCGGTGCAACTAACATGC

SEQ ID NO: 153 - protein, 25 aa, Homo sapiens
GAGAATCGGTGCAACTAACATGCCC

SEQ ID NO: 154 - protein, 25 aa, Homo sapiens
GTGCAACTAACATGCCCTTTTCGGA

SEQ ID NO: 155 - protein, 25 aa, Homo sapiens
AAAGCTTTCGTAAGGCTTCCGATTT

SEQ ID NO: 156 - protein, 25 aa, Homo sapiens
AGCGACCCTGCCGTCAGTCCGTAAA

SEQ ID NO: 157 - protein, 25 aa, Homo sapiens
TGCTTCAAGTGCAGGATCAGACCGT

SEQ ID NO: 158 - protein, 25 aa, Homo sapiens
AGACCGTGGCCCAACCTAACAGCGA

SEQ ID NO: 159 - protein, 25 aa, Homo sapiens
CCTCTCCTCTTTGCTTCAAGTGCAG

SEQ ID NO: 160 - protein, 25 aa, Homo sapiens
AGAACACTAGGGACTGGATTGGACA

SEQ ID NO: 161 - protein, 25 aa, Homo sapiens
CGACGAGAGCCCAATCGTGGGATAC

SEQ ID NO: 162 - protein, 25 aa, Homo sapiens
AGACGTGAAGCCGACGAGAGCCCAA

SEQ ID NO: 163 - protein, 25 aa, Homo sapiens
CGTGGGATACCACGGAAGAGAACAC

SEQ ID NO: 164 - protein, 25 aa, Homo sapiens
AAACGACTCGTTGCTGGATCTCCAC

SEQ ID NO: 165 - protein, 25 aa, Homo sapiens
TGGACAGAGGAGAGCTCCCCAAGGT

SEQ ID NO: 166 - protein, 25 aa, Homo sapiens
TCGGTTCCAGGCTTATTCCAGGACT

SEQ ID NO: 167 - protein, 25 aa, Homo sapiens
CAGAATCTGGTACTAAGGCTTAAAC

SEQ ID NO: 168 - protein, 25 aa, Homo sapiens
TCACTCACCGCGTCAGTGACGTTGG

SEQ ID NO: 169 - protein, 25 aa, Homo sapiens
GTAAGCTTATCGTCATCTAAAAATC

SEQ ID NO: 170 - protein, 25 aa, Homo sapiens
CCTTTTACCGTAAGCTTATCGTCAT

SEQ ID NO: 171 - protein, 25 aa, Homo sapiens
CTCACTCACCGCGTCAGTGACGTTG

SEQ ID NO: 172 - protein, 25 aa, Homo sapiens
TACAGGGATATTTGACAGTCAATTC

SEQ ID NO: 173 - protein, 25 aa, Homo sapiens
CATAGGGTACCACATTACATTACGT

SEQ ID NO: 174 - protein, 25 aa, Homo sapiens
ACTCTTCGTGACGATATCAAGAGGG

SEQ ID NO: 175 - protein, 25 aa, Homo sapiens
GAGGGTAATACTTAAAACGTTCAAC

SEQ ID NO: 176 - protein, 25 aa, Homo sapiens
ACTTTCGAACGAAGTAAGAAGGTAA

SEQ ID NO: 177 - protein, 25 aa, Homo sapiens
ACCTTAGTACTTTCGAACGAAGTAA

SEQ ID NO: 178 - protein, 25 aa, Homo sapiens
CGAACGAAGTAAGAAGGTAATTGTC

SEQ ID NO: 179 - protein, 25 aa, Homo sapiens
TAGTACTTTCGAACGAAGTAAGAAG

SEQ ID NO: 180 - protein, 25 aa, Homo sapiens
TCTTCTTCAGAATGTGGTGAGGGTT

SEQ ID NO: 181 - protein, 25 aa, Homo sapiens
CGTGTTCTCTTTCTTCCAATTCGAC

SEQ ID NO: 182 - protein, 25 aa, Homo sapiens
ACAACTCTGAAGCACCACCACGATT

SEQ ID NO: 183 - protein, 25 aa, Homo sapiens
CAAATACCGTTCAGTGAAACTGTCT

SEQ ID NO: 184 - protein, 25 aa, Homo sapiens
CAAATACCGTTCAGTGAAACTGTCT

SEQ ID NO: 185 - protein, 25 aa, Homo sapiens
ACCGTTTTAATCAGCGGAAGCAGCT

SEQ ID NO: 186 - protein, 25 aa, Homo sapiens
GCGGAAGCAGCTCTCACGGGAAGAC

SEQ ID NO: 187 - protein, 25 aa, Homo sapiens
ACAGACTGAATGACAAAGTTGTTTG

SEQ ID NO: 188 - protein, 25 aa, Homo sapiens
CGATAGCGACACACTTACAACGGAG

SEQ ID NO: 189 - protein, 25 aa, Homo sapiens
GTCCACGGTTGGTGAACATTTCCAG

SEQ ID NO: 190 - protein, 25 aa, Homo sapiens
GGTCACCAAGACATATGGACGGTCC

SEQ ID NO: 191 - protein, 25 aa, Homo sapiens
AACGGAGACCCCTAATACACTGGGT

SEQ ID NO: 192 - protein, 25 aa, Homo sapiens
AGTCGGGACAGCGACCAAGCCAAGT

SEQ ID NO: 193 - protein, 25 aa, Homo sapiens
CCATTAACAGTTTGATTTACTCAAG

SEQ ID NO: 194 - protein, 25 aa, Homo sapiens
TTTACTCAAGACGACATCAAGGAAT

SEQ ID NO: 195 - protein, 25 aa, Homo sapiens
GGAATTACACATTGGTTGTACGAAA

SEQ ID NO: 196 - protein, 25 aa, Homo sapiens
TGAACGCACTTAAACCTGTGAATAA

SEQ ID NO: 197 - protein, 25 aa, Homo sapiens
ATGGATCTAACCTTAGGAACTCCAC

SEQ ID NO: 198 - protein, 25 aa, Homo sapiens
CGTGTCATGGATCTAACCTTAGGAA

SEQ ID NO: 199 - protein, 25 aa, Homo sapiens
CTCCACATAAAGTGAACGCACTTAA

SEQ ID NO: 200 - protein, 25 aa, Homo sapiens
CAAAGTTATTGTCCAGTAACGGCTC

SEQ ID NO: 201 - protein, 25 aa, Homo sapiens
TGTCCGGATGAGAATGCTGTACACT

SEQ ID NO: 202 - protein, 25 aa, Homo sapiens
TAATTGTCAATCCTCAACTACCGTC

SEQ ID NO: 203 - protein, 25 aa, Homo sapiens
AATTCGTCGTAGGTTGTGTCCGGAT

SEQ ID NO: 204 - protein, 25 aa, Homo sapiens
TCCTTAGTAAGTGTCGTATAGAACT

SEQ ID NO: 205 - protein, 25 aa, Homo sapiens
TTAGTAAGTGTCGTATAGAACTTTC

SEQ ID NO: 206 - protein, 25 aa, Homo sapiens
TTCCTTAGTAAGTGTCGTATAGAAC

SEQ ID NO: 207 - protein, 25 aa, Homo sapiens
CCTTAGTAAGTGTCGTATAGAACTT

SEQ ID NO: 208 - protein, 25 aa, Homo sapiens
ACCAACTTTTTCTTCCAATAGACGT

SEQ ID NO: 209 - protein, 25 aa, Homo sapiens
ACTTAATTCGTTACTGTGTACTCCG

SEQ ID NO: 210 - protein, 25 aa, Homo sapiens
CTTAATTCGTTACTGTGTACTCCGA

SEQ ID NO: 211 - protein, 25 aa, Homo sapiens
AACTTAATTCGTTACTGTGTACTCC

SEQ ID NO: 212 - protein, 25 aa, Homo sapiens
AAACTTAATTCGTTACTGTGTACTC

SEQ ID NO: 213 - protein, 25 aa, Homo sapiens
TTCTTAGGTTCGTTGTCCGAGACAG

SEQ ID NO: 214 - protein, 25 aa, Homo sapiens
TTTCTTAGGTTCGTTGTCCGAGACA

SEQ ID NO: 215 - protein, 25 aa, Homo sapiens
AACAAGAAAGATCAGCTTCTTAACT

SEQ ID NO: 216 - protein, 25 aa, Homo sapiens
GAAAGATCAGCTTCTTAACTTAAAA

SEQ ID NO: 217 - protein, 25 aa, Homo sapiens
CACGTAAGAACATGCACTCCACAAA

SEQ ID NO: 218 - protein, 25 aa, Homo sapiens
CGACCACGTAAGAACATGCACTCCA

SEQ ID NO: 219 - protein, 25 aa, Homo sapiens
CCACGTAAGAACATGCACTCCACAA

SEQ ID NO: 220 - protein, 25 aa, Homo sapiens
GACCACGTAAGAACATGCACTCCAC

SEQ ID NO: 221 - protein, 25 aa, Homo sapiens
TTTGACCCGTGTTTGGTCTTTCACA

SEQ ID NO: 222 - protein, 25 aa, Homo sapiens
TTTTGACCCGTGTTTGGTCTTTCAC

SEQ ID NO: 223 - protein, 25 aa, Homo sapiens
TCCTTTTTAGCTCGTCTTTCTTACA

SEQ ID NO: 224 - protein, 25 aa, Homo sapiens
GTATCAAAGAAATGGACAGATAAAG

SEQ ID NO: 225 - protein, 25 aa, Homo sapiens
AACCTCATTAAGTCGAGATCGGGAT

SEQ ID NO: 226 - protein, 25 aa, Homo sapiens
ATCTCTCGCCAAGTTTTACGAGGGT

SEQ ID NO: 227 - protein, 25 aa, Homo sapiens
CGGGATGAGACTGAATTAGCAAGAT

SEQ ID NO: 228 - protein, 25 aa, Homo sapiens
AGTAGTATAACCTAACCAAGGTGCG

SEQ ID NO: 229 - protein, 25 aa, Homo sapiens
GGTGCGATAGTTTTTACGTTAACTG

SEQ ID NO: 230 - protein, 25 aa, Homo sapiens
CTCAAGGAAGATGTCAGTCTATAAC

SEQ ID NO: 231 - protein, 25 aa, Homo sapiens
GTGTTGTCATAGTCCTTTACTCAAG

SEQ ID NO: 232 - protein, 25 aa, Homo sapiens
AGGAGATCGTGACTTAACGATTCAG

SEQ ID NO: 233 - protein, 25 aa, Homo sapiens
AAGTTTTAGGTTTCTAGGAGATCGT

SEQ ID NO: 234 - protein, 25 aa, Homo sapiens
ACGATTCAGTGATGCTGTCACTATA

SEQ ID NO: 235 - protein, 25 aa, Homo sapiens
GGTAGTTCTTTGGACCTTAATAAGT

SEQ ID NO: 236 - protein, 25 aa, Homo sapiens
GAACGAGTAAAATTCAAACAGATTT

SEQ ID NO: 237 - protein, 25 aa, Homo sapiens
ACGAGTAAAATTCAAACAGATTTAC

SEQ ID NO: 238 - protein, 25 aa, Homo sapiens
TGAACGAGTAAAATTCAAACAGATT

SEQ ID NO: 239 - protein, 25 aa, Homo sapiens
CGAGTAAAATTCAAACAGATTTACG

SEQ ID NO: 240 - protein, 25 aa, Homo sapiens
CTAAACACGTGACCTCCCGTCAGAC

SEQ ID NO: 241 - protein, 25 aa, Homo sapiens
AGTATGAGTACCTTCTAAGCATCGG

SEQ ID NO: 242 - protein, 25 aa, Homo sapiens
ATCGGTAAAGGACCGGTCCCTAAAC

SEQ ID NO: 243 - protein, 25 aa, Homo sapiens
GTAGTAACAACCATTACGGAAAACT

SEQ ID NO: 244 - protein, 25 aa, Homo sapiens
CTATGTTCGCTGTTTTTAGCTCAAT

SEQ ID NO: 245 - protein, 25 aa, Homo sapiens
ACAAGTCTGACGTAGTGTCACGAAG

SEQ ID NO: 246 - protein, 25 aa, Homo sapiens
GCTGTTTTTAGCTCAATTTTCGTCT

SEQ ID NO: 247 - protein, 25 aa, Homo sapiens
GTGTCACGAAGGCTATGTTCGCTGT

SEQ ID NO: 248 - protein, 25 aa, Homo sapiens
AAACATTTCGTTACGTAACTTCGAC

SEQ ID NO: 249 - protein, 25 aa, Homo sapiens
ACGTGTTTCACACACTTGCACTTTT

SEQ ID NO: 250 - protein, 25 aa, Homo sapiens
AGGTGTCAAGGCACCAAACATTTCG

SEQ ID NO: 251 - protein, 25 aa, Homo sapiens
GTGTTTCACACACTTGCACTTTTAA

SEQ ID NO: 252 - protein, 25 aa, Homo sapiens
GGAGATGTGTTGGTTATGAGTTCAA

SEQ ID NO: 253 - protein, 25 aa, Homo sapiens
ACGGTGGACTAAACAGACTCTTCGG

SEQ ID NO: 254 - protein, 25 aa, Homo sapiens
GAGTTCAATCGTCACGGTGGACTAA

SEQ ID NO: 255 - protein, 25 aa, Homo sapiens
ACACGTCGTCAAGGGGGGTAATGAC

SEQ ID NO: 256 - protein, 25 aa, Homo sapiens
CAGATCTACAACTACCTTATATAGC

SEQ ID NO: 257 - protein, 25 aa, Homo sapiens
AGCTCAATCACCGTTAGACCGTTGT

SEQ ID NO: 258 - protein, 25 aa, Homo sapiens
ATCACCGTTAGACCGTTGTTATGTC

SEQ ID NO: 259 - protein, 25 aa, Homo sapiens
CCTTATATAGCTCAATCACCGTTAG

SEQ ID NO: 260 - protein, 25 aa, Homo sapiens
GGTCGGGAAGATAGTCTTGACCTAC

SEQ ID NO: 261 - protein, 25 aa, Homo sapiens
TCTTGACCTACCTCTGGACACCTGT

SEQ ID NO: 262 - protein, 25 aa, Homo sapiens
CGGGAAGATAGTCTTGACCTACCTC

SEQ ID NO: 263 - protein, 25 aa, Homo sapiens
AGACCTTATGGTCGGGAAGATAGTC

SEQ ID NO: 264 - protein, 25 aa, Homo sapiens
GACGTCTAAAAAGTGTCACCAGTAA

SEQ ID NO: 265 - protein, 25 aa, Homo sapiens
TGGAGGTCTCGTTCGGTTATTAAAC

SEQ ID NO: 266 - protein, 25 aa, Homo sapiens
TCACCAGTAAACTGGAGGTCTCGTT

SEQ ID NO: 267 - protein, 25 aa, Homo sapiens
CGACGTCTAAAAAGTGTCACCAGTA

SEQ ID NO: 268 - protein, 25 aa, Homo sapiens
TCACCTAACCTCTGGTAGTGGAAAG

SEQ ID NO: 269 - protein, 25 aa, Homo sapiens
TTCACCTAACCTCTGGTAGTGGAAA

SEQ ID NO: 270 - protein, 25 aa, Homo sapiens
ACCTAACCTCTGGTAGTGGAAAGAG

SEQ ID NO: 271 - protein, 25 aa, Homo sapiens
CACCTAACCTCTGGTAGTGGAAAGA

SEQ ID NO: 272 - protein, 25 aa, Homo sapiens
GGTTTCCTGGACACTAGAGTGGACG

SEQ ID NO: 273 - protein, 25 aa, Homo sapiens
TTAACCTGGTGATGTCCGAGACTGG

SEQ ID NO: 274 - protein, 25 aa, Homo sapiens
ACTAGGGTTGGTTTGTATCACTTCC

SEQ ID NO: 275 - protein, 25 aa, Homo sapiens
CCGAGACTGGTGTACATACTCTTCG

SEQ ID NO: 276 - protein, 25 aa, Homo sapiens
TCGAAGTCTCCAGGCTTAAACCGGT

SEQ ID NO: 277 - protein, 25 aa, Homo sapiens
CTGAAGCCGGCAATTCTAAACGAAG

SEQ ID NO: 278 - protein, 25 aa, Homo sapiens
GACCCTCTGAGCACGAGACATTCGT

SEQ ID NO: 279 - protein, 25 aa, Homo sapiens
TAGTACGACTGTATCTCCGTGGAAC

SEQ ID NO: 280 - protein, 25 aa, Homo sapiens
TTGTAAGAGTTTTCCCGTGTCCGGG

SEQ ID NO: 281 - protein, 25 aa, Homo sapiens
GACCAGCAGATAACACAGTCTTTCG

SEQ ID NO: 282 - protein, 25 aa, Homo sapiens
GACAGTTCATCAGTGTGCCTTTAAT

SEQ ID NO: 283 - protein, 25 aa, Homo sapiens
GATTGATTAACTTGATGACCAGCAG

SEQ ID NO: 284 - protein, 25 aa, Homo sapiens
CCTGTAGGTGCAACAGTGGCCTCGT

SEQ ID NO: 285 - protein, 25 aa, Homo sapiens
TCGACTTAAACCTGCTGTCGGTCAC

SEQ ID NO: 286 - protein, 25 aa, Homo sapiens
ACTCGGCGAGAAGGGAATGTCAAAG

SEQ ID NO: 287 - protein, 25 aa, Homo sapiens
GTGGCCTCGTGACTTCTACAAAAAG

SEQ ID NO: 288 - protein, 25 aa, Homo sapiens
GAGGCGGTTTAGCACTGTGGTACTT

SEQ ID NO: 289 - protein, 25 aa, Homo sapiens
AGAACATGTTTTTGAGGGAGGCGGT

SEQ ID NO: 290 - protein, 25 aa, Homo sapiens
TAACTTCGACATTTTAGAGAACATG

SEQ ID NO: 291 - protein, 25 aa, Homo sapiens
GCGGTTTAGCACTGTGGTACTTTCA

SEQ ID NO: 292 - protein, 25 aa, Homo sapiens
ACGCATGTAGAGCATAAAAGGGAAC

SEQ ID NO: 293 - protein, 25 aa, Homo sapiens
CATGGTGCACGACCCCGGTGTTTAT

SEQ ID NO: 294 - protein, 25 aa, Homo sapiens
GGGAACATCGACTTGATCCAGAAAG

SEQ ID NO: 295 - protein, 25 aa, Homo sapiens
ACGAACAGTCTTGGTAGCGGACCTG

SEQ ID NO: 296 - protein, 25 aa, Homo sapiens
GTCTTTTCGTGAGGTAAAAACGTCT

SEQ ID NO: 297 - protein, 25 aa, Homo sapiens
GAATTACGCCGTGTCAACCTGATCT

SEQ ID NO: 298 - protein, 25 aa, Homo sapiens
AAGGTGAACTGGATGCATGAGATGT

SEQ ID NO: 299 - protein, 25 aa, Homo sapiens
CCCTTACATTACTTCACGGTTTTTA

SEQ ID NO: 300 - protein, 25 aa, Homo sapiens
CTTTGTACCGCTAGGTGTACCAGAT

SEQ ID NO: 301 - protein, 25 aa, Homo sapiens
CGAACCCCTAACATAAACCTGGATG

SEQ ID NO: 302 - protein, 25 aa, Homo sapiens
ACCAGATGGTCTTGGTCTATCGACT

SEQ ID NO: 303 - protein, 25 aa, Homo sapiens
AACCTGGATGGGAAGACGCTCGACT

SEQ ID NO: 304 - protein, 25 aa, Homo sapiens
ATTCTAGAAGCCGAGTCTCCTTCTG

SEQ ID NO: 305 - protein, 25 aa, Homo sapiens
CATTCTAGAAGCCGAGTCTCCTTCT

SEQ ID NO: 306 - protein, 25 aa, Homo sapiens
TCTAGAAGCCGAGTCTCCTTCTGAC

SEQ ID NO: 307 - protein, 25 aa, Homo sapiens
CTAGAAGCCGAGTCTCCTTCTGACT

SEQ ID NO: 308 - protein, 25 aa, Homo sapiens
CGATGACTTATGCAAGTGTAGACAG

SEQ ID NO: 309 - protein, 25 aa, Homo sapiens
ATGTAAAGACATTTGTATAAAGACT

SEQ ID NO: 310 - protein, 25 aa, Homo sapiens
GAAAGTTCGCTGTCTACGGAGTAAA

SEQ ID NO: 311 - protein, 25 aa, Homo sapiens
AACACAAATTCAAGGTTTGTAAACT

SEQ ID NO: 312 - protein, 25 aa, Homo sapiens
GGTGTAAGACTACTCGTTGGCGAAG

SEQ ID NO: 313 - protein, 25 aa, Homo sapiens
CCTGAGTTAGGGATCCCGACCGTCT

SEQ ID NO: 314 - protein, 25 aa, Homo sapiens
CGGGAAAACAACTCGGTCCGGAGAG

SEQ ID NO: 315 - protein, 25 aa, Homo sapiens
TTCTCCTAGAGGACAGGTAGTCGGT

SEQ ID NO: 316 - protein, 25 aa, Homo sapiens
GGTTTCCGCCGGTCCTATATTGACT

SEQ ID NO: 317 - protein, 25 aa, Homo sapiens
TTGACTGAAGTGGTACGTTAAACAC

SEQ ID NO: 318 - protein, 25 aa, Homo sapiens
TTGTACGGGCAGAAGGACCCTCCCT

SEQ ID NO: 319 - protein, 25 aa, Homo sapiens
GACCTTAAACTCAGACGGGTCAAGG

SEQ ID NO: 320 - protein, 25 aa, Homo sapiens
GCGGGGGTAGGGATCCTTTTCGACC

SEQ ID NO: 321 - protein, 25 aa, Homo sapiens
TTACGATACCTTACTTCGGGAAGAG

SEQ ID NO: 322 - protein, 25 aa, Homo sapiens
ACTTACGATACCTTACTTCGGGAAG

SEQ ID NO: 323 - protein, 25 aa, Homo sapiens
AACTGTTAAAACGTAATTACATTTA

SEQ ID NO: 324 - protein, 25 aa, Homo sapiens
AGGACGCACAACTTTCTACTATTCG

SEQ ID NO: 325 - protein, 25 aa, Homo sapiens
CCACAAGAGGTACAGGAAACATGTT

SEQ ID NO: 326 - protein, 25 aa, Homo sapiens
TAGACATGGACAGGACGCACAACTT

SEQ ID NO: 327 - protein, 25 aa, Homo sapiens
ACTATTCGGGTGAGATGTCGACCTC

SEQ ID NO: 328 - protein, 25 aa, Homo sapiens
CGTGCTACGTGGACATGCTAGTGAC

SEQ ID NO: 329 - protein, 25 aa, Homo sapiens
ATTGCTCCGAATACACGTGCTACGT

SEQ ID NO: 330 - protein, 25 aa, Homo sapiens
AGACCAGGTATACTTGACTTTCGAG

SEQ ID NO: 331 - protein, 25 aa, Homo sapiens
AGTGACTTGACGTGCGAGGCCCTGA

SEQ ID NO: 332 - protein, 25 aa, Homo sapiens
GGAGGGACACCCGATCACAATACTG

SEQ ID NO: 333 - protein, 25 aa, Homo sapiens
CGACCTTGGGTACAGATTATCACAG

SEQ ID NO: 334 - protein, 25 aa, Homo sapiens
GTCCCCGGAAAGTGAATGTAACAGT

SEQ ID NO: 335 - protein, 25 aa, Homo sapiens
ATTCATCGAGACAACGAGCCGGTGT

SEQ ID NO: 336 - protein, 25 aa, Homo sapiens
GTCCGGCGCAGTCAACAACACCGGT

SEQ ID NO: 337 - protein, 25 aa, Homo sapiens
CCTACCGCCGTAGGTCGATGCTTAG

SEQ ID NO: 338 - protein, 25 aa, Homo sapiens
CGCAGTCAACAACACCGGTACCTGT

SEQ ID NO: 339 - protein, 25 aa, Homo sapiens
ATGCTTAGAGGCTGGTGGTGATGTC

SEQ ID NO: 340 - protein, 25 aa, Homo sapiens
CCTACTGAACAAGAAACTTCGACTA

SEQ ID NO: 341 - protein, 25 aa, Homo sapiens
CGTTACTCCTACTGAACAAGAAACT

SEQ ID NO: 342 - protein, 25 aa, Homo sapiens
TACTCCTACTGAACAAGAAACTTCG

SEQ ID NO: 343 - protein, 25 aa, Homo sapiens
CTCCTACTGAACAAGAAACTTCGAC

SEQ ID NO: 344 - protein, 25 aa, Homo sapiens
TCATGGACTCGAGCGGTCACTTTAC

SEQ ID NO: 345 - protein, 25 aa, Homo sapiens
GCGGTCACTTTACTACCGAATAATG

SEQ ID NO: 346 - protein, 25 aa, Homo sapiens
TGGACTCGAGCGGTCACTTTACTAC

SEQ ID NO: 347 - protein, 25 aa, Homo sapiens
TCGAGCGGTCACTTTACTACCGAAT

SEQ ID NO: 348 - protein, 25 aa, Homo sapiens
CAGTACCCCTTCAGTGAGTAAAAGA

SEQ ID NO: 349 - protein, 25 aa, Homo sapiens
CGGCAGTACCCCTTCAGTGAGTAAA

SEQ ID NO: 350 - protein, 25 aa, Homo sapiens
ACTTGCATCGGCAGTACCCCTTCAG

SEQ ID NO: 351 - protein, 25 aa, Homo sapiens
CTTTAGTGTGTACTTGCATCGGCAG

SEQ ID NO: 352 - protein, 25 aa, Homo sapiens
TATAAGACCCTTACCTATGACGAAT

SEQ ID NO: 353 - protein, 25 aa, Homo sapiens
GAATACTGAGCCCTTTATAAGACCC

SEQ ID NO: 354 - protein, 25 aa, Homo sapiens
TTCCAATCACAGTTTCGGAGACGAG

SEQ ID NO: 355 - protein, 25 aa, Homo sapiens
GTTGATCCACGATTCCCTCAGAGAG

SEQ ID NO: 356 - protein, 25 aa, Homo sapiens
CGGTATTTTTGTCGCTCCCTCTTTG

SEQ ID NO: 357 - protein, 25 aa, Homo sapiens
TGGAGAAGCTCCGTGTTCCGTGTTG

SEQ ID NO: 358 - protein, 25 aa, Homo sapiens
TCTATGGTTTGGAGAAGCTCCGTGT

SEQ ID NO: 359 - protein, 25 aa, Homo sapiens
GGTTTGGAGAAGCTCCGTGTTCCGT

SEQ ID NO: 360 - protein, 25 aa, Homo sapiens
ATCGAGTTACCTCGGGGCCTAGGGT

SEQ ID NO: 361 - protein, 25 aa, Homo sapiens
TACCTCGGGGCCTAGGGTTCGGGAC

SEQ ID NO: 362 - protein, 25 aa, Homo sapiens
ACAGTGGATCGAGTTACCTCGGGGC

SEQ ID NO: 363 - protein, 25 aa, Homo sapiens
GTGGGACAGTGGATCGAGTTACCTC

SEQ ID NO: 364 - protein, 25 aa, Homo sapiens
CACTGCTGCTCCTGTGACGGAAGGG

SEQ ID NO: 365 - protein, 25 aa, Homo sapiens
CCGTCGCCCACAACCACGATCTCGA

SEQ ID NO: 366 - protein, 25 aa, Homo sapiens
CGTCGCCCACAACCACGATCTCGAC

SEQ ID NO: 367 - protein, 25 aa, Homo sapiens
GCCTACCAGTGGACTTTTCGTCCGG

SEQ ID NO: 368 - protein, 25 aa, Homo sapiens
TACGCCGGCCTACCAGTGGACTTTT

SEQ ID NO: 369 - protein, 25 aa, Homo sapiens
GTCGGGACGAGATACGCCGGCCTAC

SEQ ID NO: 370 - protein, 25 aa, Homo sapiens
TGGACTTTTCGTCCGGGTCGTGGAC

SEQ ID NO: 371 - protein, 25 aa, Homo sapiens
CACACGGGACAACGATGGGGTTGGG

SEQ ID NO: 372 - protein, 25 aa, Homo sapiens
GACCACAGACTGGAAAGAGGAGATC

SEQ ID NO: 373 - protein, 25 aa, Homo sapiens
ACGGGACAACGATGGGGTTGGGGGT

SEQ ID NO: 374 - DNA, 25 bp, Homo sapiens
tcgaccacagactggaaagaggaga

SEQ ID NO: 375 - protein, 25 aa, Homo sapiens
CTGGCAGACTTCCATGGTCGACCCG

SEQ ID NO: 376 - protein, 25 aa, Homo sapiens
GTGGACTTCACCTGGAGAACCCTGG

SEQ ID NO: 377 - protein, 25 aa, Homo sapiens
CCTCAGCGACGACCGAGTAGAAGTC

SEQ ID NO: 378 - protein, 25 aa, Homo sapiens
TCACCTGGAGAACCCTGGCAGACTT

SEQ ID NO: 379 - protein, 25 aa, Homo sapiens
GCCGTCGATCGGACTCTACAGTCTT

SEQ ID NO: 380 - protein, 25 aa, Homo sapiens
CTAAGGTGGCCAGTTGGCACGGGTC

SEQ ID NO: 381 - protein, 25 aa, Homo sapiens
CTGAAACACCATCGCCGTCGATCGG

SEQ ID NO: 382 - protein, 25 aa, Homo sapiens
GACTCTACAGTCTTGATGCCCTAAG

SEQ ID NO: 383 - protein, 25 aa, Homo sapiens
TGTTTCGGGACCTTCAGACCTCACA

SEQ ID NO: 384 - protein, 25 aa, Homo sapiens
GGGACTTCGGAGACTACAAACTCTT

SEQ ID NO: 385 - protein, 25 aa, Homo sapiens
GTCGTCTTCCTTGACTTGTTTCGGG

SEQ ID NO: 386 - protein, 25 aa, Homo sapiens
CCTCACACCCGGGAGGGGACTTCGG

SEQ ID NO: 387 - protein, 25 aa, Homo sapiens
AGGAGATGCATGACCGTCGACGGTT

SEQ ID NO: 388 - protein, 25 aa, Homo sapiens
TAGATCTCGACCGAAGCCGAAGACG

SEQ ID NO: 389 - protein, 25 aa, Homo sapiens
GTCCTGACCTGACGTGAGTCCCTCG

SEQ ID NO: 390 - protein, 25 aa, Homo sapiens
CGGTTGGACATACGGGTCTACGTAC

SEQ ID NO: 391 - protein, 25 aa, Homo sapiens
GGGAGTCTCGTCTCCATCCGTAAAG

SEQ ID NO: 392 - protein, 25 aa, Homo sapiens
GGTCTCTCTCGGTACGAACACGTAT

SEQ ID NO: 393 - protein, 25 aa, Homo sapiens
ACCCTAAGACATCCCTCGAGGTTCT

SEQ ID NO: 394 - protein, 25 aa, Homo sapiens
CGTTTCCGTCCGTGAGTTTGTCTAG

SEQ ID NO: 395 - protein, 25 aa, Homo sapiens
CACGAACTCCTACCTTGAGGGAAGA

SEQ ID NO: 396 - protein, 25 aa, Homo sapiens
CAGTCCAGGGTTTGTCACAGGGGTC

SEQ ID NO: 397 - protein, 25 aa, Homo sapiens
GGGAAGACCAGTCCAGGGTTTGTCA

SEQ ID NO: 398 - protein, 25 aa, Homo sapiens
CGAACTCCTACCTTGAGGGAAGACC

SEQ ID NO: 399 - protein, 25 aa, Homo sapiens
TCGGGTCGTCGAAGATGAATGGATG

SEQ ID NO: 400 - protein, 25 aa, Homo sapiens
CGGGTCGTCGAAGATGAATGGATGG

SEQ ID NO: 401 - protein, 25 aa, Homo sapiens
GTCGTCGAAGATGAATGGATGGATC

SEQ ID NO: 402 - protein, 25 aa, Homo sapiens
CACACCGATCCCCAACCCTGCGACC

SEQ ID NO: 403 - protein, 25 aa, Homo sapiens
CGACTCCGTGAAGGGTGGATTATTT

SEQ ID NO: 404 - protein, 25 aa, Homo sapiens
TTTGAGACGAAAGTAATACCGTAGT

SEQ ID NO: 405 - protein, 25 aa, Homo sapiens
TACCGTAGTTTGTCGACGACTCCGT

SEQ ID NO: 406 - protein, 25 aa, Homo sapiens
ACGACTCCGTGAAGGGTGGATTATT

SEQ ID NO: 407 - protein, 25 aa, Homo sapiens
CACACCGCACCCGAGAACCGGTGAC

SEQ ID NO: 408 - protein, 25 aa, Homo sapiens
ACACCGCACCCGAGAACCGGTGACC

SEQ ID NO: 409 - protein, 25 aa, Homo sapiens
AGGACTCTCACGCAGGTGTCTTGAC

SEQ ID NO: 410 - protein, 25 aa, Homo sapiens
CTCTCACGCAGGTGTCTTGACCGTT

SEQ ID NO: 411 - protein, 25 aa, Homo sapiens
GACTCTCACGCAGGTGTCTTGACCG

SEQ ID NO: 412 - protein, 25 aa, Homo sapiens
CCCAGGACTCTCACGCAGGTGTCTT

SEQ ID NO: 413 - protein, 25 aa, Homo sapiens
CGGTGTCTGTGAGTGGAATGACTTC

SEQ ID NO: 414 - protein, 25 aa, Homo sapiens
CCTACTCGGTGTCTGTGAGTGGAAT

SEQ ID NO: 415 - protein, 25 aa, Homo sapiens
TGTACCTACTCGGTGTCTGTGAGTG

SEQ ID NO: 416 - protein, 25 aa, Homo sapiens
ACTCGGTGTCTGTGAGTGGAATGAC

SEQ ID NO: 417 - protein, 25 aa, Homo sapiens
AAACTTCTTGAGAAGGCTGACAGAC

SEQ ID NO: 418 - protein, 25 aa, Homo sapiens
GAAGGCTGACAGACGTCTCTGGTAG

SEQ ID NO: 419 - protein, 25 aa, Homo sapiens
ACTTCTTGAGAAGGCTGACAGACGT

SEQ ID NO: 420 - protein, 25 aa, Homo sapiens
CTTGAGAAGGCTGACAGACGTCTCT

SEQ ID NO: 421 - protein, 25 aa, Homo sapiens
CCGCGATACACCGACGAGCAACGTG

SEQ ID NO: 422 - protein, 25 aa, Homo sapiens
AACGTGGGTGATAGACTTCGGTGAC

SEQ ID NO: 423 - protein, 25 aa, Homo sapiens
GGATGGGACAGACATGGCACGCCAT

SEQ ID NO: 424 - protein, 25 aa, Homo sapiens
ATGGCACGCCATGAAGGGATCGTGT

SEQ ID NO: 425 - protein, 25 aa, Homo sapiens
GAACTGAAGCCTCCAGTCAGGGAAC

SEQ ID NO: 426 - protein, 25 aa, Homo sapiens
ACTCACGAACTGAAGCCTCCAGTCA

SEQ ID NO: 427 - protein, 25 aa, Homo sapiens
AAGCCTCCAGTCAGGGAACGGGTGT

SEQ ID NO: 428 - protein, 25 aa, Homo sapiens
ACTGAAGCCTCCAGTCAGGGAACGG

SEQ ID NO: 429 - protein, 25 aa, Homo sapiens
GAGGGCACACCTACCACACCGACGA

SEQ ID NO: 430 - protein, 25 aa, Homo sapiens
TCTGAATGTCCACTAGGGCGAGTGG

SEQ ID NO: 431 - protein, 25 aa, Homo sapiens
GGTGTCTCGTGTAGATACCCCTATT

SEQ ID NO: 432 - protein, 25 aa, Homo sapiens
CACTAGGGCGAGTGGATGGGTGACC

SEQ ID NO: 433 - protein, 25 aa, Homo sapiens
CACTCACGACTGGGGAGAGGTGTGA

SEQ ID NO: 434 - protein, 25 aa, Homo sapiens
ACTCACGACTGGGGAGAGGTGTGAG

SEQ ID NO: 435 - protein, 25 aa, Homo sapiens
TCGCGAGGTTAGAGTCGGCAGTCAA

SEQ ID NO: 436 - protein, 25 aa, Homo sapiens
ACGAGTTTCAGAAACGGGATCACCC

SEQ ID NO: 437 - protein, 25 aa, Homo sapiens
TACCTGGTGTATCTCGCGAGGTTAG

SEQ ID NO: 438 - protein, 25 aa, Homo sapiens
CTGACAACAACTGTACCTGGTGTAT

SEQ ID NO: 439 - protein, 25 aa, Homo sapiens
TCCGTCGGCGATACTACCCGTTTAA

SEQ ID NO: 440 - protein, 25 aa, Homo sapiens
AGTCCTCTTTGACTCTGCGGTCGTG

SEQ ID NO: 441 - protein, 25 aa, Homo sapiens
ACTACCCGTTTAACGTCACAAACCC

SEQ ID NO: 442 - protein, 25 aa, Homo sapiens
TTGACTCTGCGGTCGTGATGGAGGA

SEQ ID NO: 443 - protein, 25 aa, Homo sapiens
CGGGAGCTAACAGAAGGCCTTCTAC

SEQ ID NO: 444 - protein, 25 aa, Homo sapiens
ATGAAACTACGGGAGCTAACAGAAG

SEQ ID NO: 445 - protein, 25 aa, Homo sapiens
AACAGAAGGCCTTCTACCCCTCGAG

SEQ ID NO: 446 - protein, 25 aa, Homo sapiens
CAGAAGGCCTTCTACCCCTCGAGGA

SEQ ID NO: 447 - protein, 25 aa, Homo sapiens
TGGGTCGCGATCTCTCGTCGGGACC

SEQ ID NO: 448 - protein, 25 aa, Homo sapiens
GACCCACTTCGGAGGTCGGTCCTAG

SEQ ID NO: 449 - protein, 25 aa, Homo sapiens
CACAGTCTCCCGTGGGTCGCGATCT

SEQ ID NO: 450 - protein, 25 aa, Homo sapiens
GGACCTCGGAAGTGGTTGGACCCAC

SEQ ID NO: 451 - protein, 25 aa, Homo sapiens
GAACTCGGGATACCACCGGTACGAC

SEQ ID NO: 452 - protein, 25 aa, Homo sapiens
TCAGCGGGATTCGTCACGTCCACAG

SEQ ID NO: 453 - protein, 25 aa, Homo sapiens
GACCTTGGTGACTTCGCCTGTCTCC

SEQ ID NO: 454 - protein, 25 aa, Homo sapiens
TACTCCGGGATCACGCCTGTCAGCG

SEQ ID NO: 455 - protein, 25 aa, Homo sapiens
ATACGGGTGTCTCAGGATGGTTGTC

SEQ ID NO: 456 - protein, 25 aa, Homo sapiens
GTCCGACCCCGATGATACGGGTGTC

SEQ ID NO: 457 - protein, 25 aa, Homo sapiens
ACCCCGATGATACGGGTGTCTCAGG

SEQ ID NO: 458 - protein, 25 aa, Homo sapiens
CGACCCCGATGATACGGGTGTCTCA

SEQ ID NO: 459 - protein, 25 aa, Homo sapiens
ACGTAGTCCGGAAGACACGTGACGT

SEQ ID NO: 460 - protein, 25 aa, Homo sapiens
TAGTCCGGAAGACACGTGACGTGTT

SEQ ID NO: 461 - protein, 25 aa, Homo sapiens
GTAGTCCGGAAGACACGTGACGTGT

SEQ ID NO: 462 - protein, 25 aa, Homo sapiens
CGTGGAGGTACCGGCCGGTGGGGTC

SEQ ID NO: 463 - protein, 25 aa, Homo sapiens
AAAGAGAGCCATGAACGCACCACCC

SEQ ID NO: 464 - protein, 25 aa, Homo sapiens
TGTTGAAAGAGAGCCATGAACGCAC

SEQ ID NO: 465 - protein, 25 aa, Homo sapiens
CATGAACGCACCACCCCGATAGTGA

SEQ ID NO: 466 - protein, 25 aa, Homo sapiens
CTCTGTGTTGTTGAAAGAGAGCCAT

SEQ ID NO: 467 - protein, 25 aa, Homo sapiens
CCAACTCGAGTTGCTGACACTAGGG

SEQ ID NO: 468 - protein, 25 aa, Homo sapiens
GAACCACTGAAAGAGCCCTTAACTC

SEQ ID NO: 469 - protein, 25 aa, Homo sapiens
CCCGGTTATGGGTGATGAAGGCACT

SEQ ID NO: 470 - protein, 25 aa, Homo sapiens
TTAACTCCCTTACCAACTCGAGTTG

SEQ ID NO: 471 - protein, 25 aa, Homo sapiens
AAGACACTGAAACCACTCCTGAAGT

SEQ ID NO: 472 - protein, 25 aa, Homo sapiens
AAGACACTGAAACCACTCCTGAAGT

SEQ ID NO: 473 - protein, 25 aa, Homo sapiens
CAAGACACTGAAACCACTCCTGAAG

SEQ ID NO: 474 - protein, 25 aa, Homo sapiens
TCCACCCGTGGAACACAGTATTCGT

SEQ ID NO: 475 - protein, 25 aa, Homo sapiens
GACTTCCACCCGTGGAACACAGTAT

SEQ ID NO: 476 - protein, 25 aa, Homo sapiens
CCGTGGAACACAGTATTCGTACCTC

SEQ ID NO: 477 - protein, 25 aa, Homo sapiens
TCAAACGAAAGACCGCCGACTGTGG

SEQ ID NO: 478 - protein, 25 aa, Homo sapiens
ACGTGTGCCCACTGTAGTGACTCCT

SEQ ID NO: 479 - protein, 25 aa, Homo sapiens
GAGTTGTCTCGACAGGTCCAGCAGC

SEQ ID NO: 480 - protein, 25 aa, Homo sapiens
GAGAGTTCTCGAGAACCGAGTCGAG

SEQ ID NO: 481 - protein, 25 aa, Homo sapiens
ACTCCTGGACGACAACCTGAAGGTC

SEQ ID NO: 482 - protein, 25 aa, Homo sapiens
ACCCGTCGGAGTGAGACGTACTAGG

SEQ ID NO: 483 - protein, 25 aa, Homo sapiens
CGTCGGAGTGAGACGTACTAGGGGT

SEQ ID NO: 484 - protein, 25 aa, Homo sapiens
CCCGTCGGAGTGAGACGTACTAGGG

SEQ ID NO: 485 - protein, 25 aa, Homo sapiens
GGGTGGACGACCAGGCTGGACCGAC

SEQ ID NO: 486 - protein, 25 aa, Homo sapiens
TACCTACGGGACCTGCGAAGCTTCG

SEQ ID NO: 487 - protein, 25 aa, Homo sapiens
TGCGAAGCTTCGATGACCTACTCCT

SEQ ID NO: 488 - protein, 25 aa, Homo sapiens
ACCTGCGAAGCTTCGATGACCTACT

SEQ ID NO: 489 - protein, 25 aa, Homo sapiens
ACGGGACCTGCGAAGCTTCGATGAC

SEQ ID NO: 490 - protein, 25 aa, Homo sapiens
ATGACAGTGGCGGTGGATGTGTTTC

SEQ ID NO: 491 - protein, 25 aa, Homo sapiens
CGGTGGATGTGTTTCTGGGATAGAG

SEQ ID NO: 492 - protein, 25 aa, Homo sapiens
ACAGTGGCGGTGGATGTGTTTCTGG

SEQ ID NO: 493 - protein, 25 aa, Homo sapiens
GTGGCGGTGGATGTGTTTCTGGGAT

SEQ ID NO: 494 - protein, 25 aa, Homo sapiens
GACACTGGTCGTCGCAGGGAATAAG

SEQ ID NO: 495 - protein, 25 aa, Homo sapiens
CCAAGGACAAACGTGACCGATGTCG

SEQ ID NO: 496 - protein, 25 aa, Homo sapiens
TAAGCGAACCGGAACCAAGGACAAA

SEQ ID NO: 497 - protein, 25 aa, Homo sapiens
GTCGTCGCAGGGAATAAGCGAACCG

SEQ ID NO: 498 - protein, 25 aa, Homo sapiens
CAGGAGAGATAGGACCTACTCGAGT

SEQ ID NO: 499 - protein, 25 aa, Homo sapiens
GGGCCCTTTCATGCAGATCTAACAC

SEQ ID NO: 500 - protein, 25 aa, Homo sapiens
GAAAGACAAGTCAGGATTTTAAGCT

SEQ ID NO: 501 - protein, 25 aa, Homo sapiens
ACCAAACGGAGTAACACGATAAACG

SEQ ID NO: 502 - protein, 25 aa, Homo sapiens
CCCCGTCTCTGTCGTACCCCTTCCT

SEQ ID NO: 503 - protein, 25 aa, Homo sapiens
CAAGACCTGTCTGAAGGGAGAGGAC

SEQ ID NO: 504 - protein, 25 aa, Homo sapiens
AGTAATTCCCGAACCCCGTCTCTGT

SEQ ID NO: 505 - protein, 25 aa, Homo sapiens
GGGAGAGGACGAAGTAATTCCCGAA

SEQ ID NO: 506 - protein, 25 aa, Homo sapiens
GGGATAAGGACGACGTTTACAGATT

SEQ ID NO: 507 - protein, 25 aa, Homo sapiens
GACAGATGACGTTGACACTAAAGGG

SEQ ID NO: 508 - protein, 25 aa, Homo sapiens
GGAGGGATAAGGACGACGTTTACAG

SEQ ID NO: 509 - protein, 25 aa, Homo sapiens
AGGGATAAGGACGACGTTTACAGAT

SEQ ID NO: 510 - protein, 25 aa, Homo sapiens
CTGCATTAGTGACTGTAACTCTACC

SEQ ID NO: 511 - protein, 25 aa, Homo sapiens
AGGAAACTAGGCCTGCTGCATTAGT

SEQ ID NO: 512 - protein, 25 aa, Homo sapiens
CTTCACTACTCGAAAGGAAACTAGG

SEQ ID NO: 513 - protein, 25 aa, Homo sapiens
GGCCTGCTGCATTAGTGACTGTAAC

SEQ ID NO: 514 - protein, 25 aa, Homo sapiens
TCGACACCGACATATACTAATGGTT

SEQ ID NO: 515 - protein, 25 aa, Homo sapiens
AGTCGACACCGACATATACTAATGG

SEQ ID NO: 516 - protein, 25 aa, Homo sapiens
GTCGACACCGACATATACTAATGGT

SEQ ID NO: 517 - protein, 25 aa, Homo sapiens
GACACCGACATATACTAATGGTTCC

SEQ ID NO: 518 - protein, 25 aa, Homo sapiens
CCTCCACGAGCTCGGACTTCTAAGA

SEQ ID NO: 519 - protein, 25 aa, Homo sapiens
CCACGAGCTCGGACTTCTAAGAAGA

SEQ ID NO: 520 - protein, 25 aa, Homo sapiens
CTGATACTCCTCCACGAGCTCGGAC

SEQ ID NO: 521 - protein, 25 aa, Homo sapiens
CCCTGATACTCCTCCACGAGCTCGG

SEQ ID NO: 522 - protein, 25 aa, Homo sapiens
CAACTCCTCTACCTGTCCGTACTCG

SEQ ID NO: 523 - protein, 25 aa, Homo sapiens
TCCTCTACCTGTCCGTACTCGTCCT

SEQ ID NO: 524 - protein, 25 aa, Homo sapiens
TGCAACTCCTCTACCTGTCCGTACT

SEQ ID NO: 525 - protein, 25 aa, Homo sapiens
ACTCCTCTACCTGTCCGTACTCGTC

SEQ ID NO: 526 - protein, 25 aa, Homo sapiens
CTCGGGCTCGGACTCTTACTGATAC

SEQ ID NO: 527 - protein, 25 aa, Homo sapiens
CGGGCTCGGACTCTTACTGATACTC

SEQ ID NO: 528 - protein, 25 aa, Homo sapiens
CATGCTTCGTCTCGGACTCGGACTC

SEQ ID NO: 529 - protein, 25 aa, Homo sapiens
TGCTTCGTCTCGGACTCGGACTCGG

SEQ ID NO: 530 - protein, 25 aa, Homo sapiens
TCGAGACGGGGGATCCTGAGACCTT

SEQ ID NO: 531 - protein, 25 aa, Homo sapiens
GGAGGTAGTAGTCTCAGACTCGGAC

SEQ ID NO: 532 - protein, 25 aa, Homo sapiens
TGGGTCACGGGAACGACGGGTAATC

SEQ ID NO: 533 - protein, 25 aa, Homo sapiens
ACGGGTAATCCGTCTGAGAGGGCCT

SEQ ID NO: 534 - protein, 25 aa, Homo sapiens
ACCGGAGGTCAACCCTGAGGAGGTA

SEQ ID NO: 535 - protein, 25 aa, Homo sapiens
TGACGGGTTCTTTTAGAGGAGTCTC

SEQ ID NO: 536 - protein, 25 aa, Homo sapiens
GGTCACTATCGATACCTTCTCGGTC

SEQ ID NO: 537 - protein, 25 aa, Homo sapiens
TCACTATCGATACCTTCTCGGTCGT

SEQ ID NO: 538 - protein, 25 aa, Homo sapiens
CTCGGTCGTCATGGCCGGGGTGACG

SEQ ID NO: 539 - protein, 25 aa, Homo sapiens
AAACCACCGGTCATACCTTAGGTCT

SEQ ID NO: 540 - protein, 25 aa, Homo sapiens
AACCACCGGTCATACCTTAGGTCTT

SEQ ID NO: 541 - protein, 25 aa, Homo sapiens
CCGAAACCACCGGTCATACCTTAGG

SEQ ID NO: 542 - protein, 25 aa, Homo sapiens
CGAAACCACCGGTCATACCTTAGGT

SEQ ID NO: 543 - protein, 25 aa, Homo sapiens
ACCTCTTCCTATTTACCCTGTTTCG

SEQ ID NO: 544 - protein, 25 aa, Homo sapiens
CTCTCTGCCTCTTTGTGCTCAGGGT

SEQ ID NO: 545 - protein, 25 aa, Homo sapiens
TTCGTCGAGACCCTATACTGATGTT

SEQ ID NO: 546 - protein, 25 aa, Homo sapiens
GATGTTCCCTCTCTGCCTCTTTGTG

SEQ ID NO: 547 - protein, 25 aa, Homo sapiens
GTCGTCAGCCGAAACTAATATTTCC

SEQ ID NO: 548 - protein, 25 aa, Homo sapiens
TCGTCAGCCGAAACTAATATTTCCT

SEQ ID NO: 549 - protein, 25 aa, Homo sapiens
GTCAGCCGAAACTAATATTTCCTCT

SEQ ID NO: 550 - protein, 25 aa, Homo sapiens
AGTCGTCAGCCGAAACTAATATTTC

SEQ ID NO: 551 - protein, 25 aa, Homo sapiens
ACGAGACATCATAGGACACAGGTAT

SEQ ID NO: 552 - protein, 25 aa, Homo sapiens
TGGGTCAGTCACACAGTACATTTAG

SEQ ID NO: 553 - protein, 25 aa, Homo sapiens
CGGACGGAAACGAATTAGTGGCTAA

SEQ ID NO: 554 - protein, 25 aa, Homo sapiens
CGAGGTTTTGAGACGCCATTACAAC

SEQ ID NO: 555 - protein, 25 aa, Homo sapiens
AATTAATCCACCTGTACGTAGGAAT

SEQ ID NO: 556 - protein, 25 aa, Homo sapiens
AACAATTAATCCACCTGTACGTAGG

SEQ ID NO: 557 - protein, 25 aa, Homo sapiens
ACAATTAATCCACCTGTACGTAGGA

SEQ ID NO: 558 - protein, 25 aa, Homo sapiens
TTAATCCACCTGTACGTAGGAATTT

SEQ ID NO: 559 - protein, 25 aa, Homo sapiens
TGTCGAGGAAGTGTCAATCGACTCT

SEQ ID NO: 560 - protein, 25 aa, Homo sapiens
GTCGAGGAAGTGTCAATCGACTCTA

SEQ ID NO: 561 - protein, 25 aa, Homo sapiens
CTCCTGTCGAGGAAGTGTCAATCGA

SEQ ID NO: 562 - protein, 25 aa, Homo sapiens
CCTGTCGAGGAAGTGTCAATCGACT

SEQ ID NO: 563 - protein, 25 aa, Homo sapiens
CTTAGTAGATTCGAGAAGAAAACCG

SEQ ID NO: 564 - protein, 25 aa, Homo sapiens
ATGAGTACGGCAAATCCTTTTGTCT

SEQ ID NO: 565 - protein, 25 aa, Homo sapiens
AATCGTAGTTAGATACTTCAGGTCT

SEQ ID NO: 566 - protein, 25 aa, Homo sapiens
TATTAAGGAGTTCGGTGACCAAAAA

SEQ ID NO: 567 - protein, 25 aa, Homo sapiens
CGACACTCCTGGACTGTGGCAGTGT

SEQ ID NO: 568 - protein, 25 aa, Homo sapiens
GGAACCACGGTTACAACCTTCGGTG

SEQ ID NO: 569 - protein, 25 aa, Homo sapiens
TACCTCCGTGTACGAAGAAACAACT

SEQ ID NO: 570 - protein, 25 aa, Homo sapiens
CCTTCGGTGTACGACTCGACTTTCT

SEQ ID NO: 571 - protein, 25 aa, Homo sapiens
CTGGTGAGAGAGAGGGTTGGTGGGT

SEQ ID NO: 572 - protein, 25 aa, Homo sapiens
CATTCACTGGTGAGAGAGAGGGTTG

SEQ ID NO: 573 - protein, 25 aa, Homo sapiens
CACTGGTGAGAGAGAGGGTTGGTGG

SEQ ID NO: 574 - protein, 25 aa, Homo sapiens
TTCACTGGTGAGAGAGAGGGTTGGT

SEQ ID NO: 575 - protein, 25 aa, Homo sapiens
GTACTCATACAACGGCTCCACCTCT

SEQ ID NO: 576 - protein, 25 aa, Homo sapiens
CGAAACCCCCGTTCATGCCTCAACT

SEQ ID NO: 577 - protein, 25 aa, Homo sapiens
CGTGAGAAGAGTCTGCCTACGACGG

SEQ ID NO: 578 - protein, 25 aa, Homo sapiens
ATGCCTCAACTCTCCCTGTCCCGTC

SEQ ID NO: 579 - protein, 25 aa, Homo sapiens
GATACCTCCAGCCAAACCTCATCTT

SEQ ID NO: 580 - protein, 25 aa, Homo sapiens
CTCAGTCCCGGGTTTCGTAGGGTAC

SEQ ID NO: 581 - protein, 25 aa, Homo sapiens
CTCATCTTTCTCTGGCTTACCTGTT

SEQ ID NO: 582 - protein, 25 aa, Homo sapiens
CTCATCTTTCTCTGGCTTACCTGTT

SEQ ID NO: 583 - protein, 25 aa, Homo sapiens
TACTCGGAACCAGTACACCAAAGAA

SEQ ID NO: 584 - protein, 25 aa, Homo sapiens
CGGAACCAGTACACCAAAGAAGGTC

SEQ ID NO: 585 - protein, 25 aa, Homo sapiens
CTCGGAACCAGTACACCAAAGAAGG

SEQ ID NO: 586 - protein, 25 aa, Homo sapiens
TCGGAACCAGTACACCAAAGAAGGT

SEQ ID NO: 587 - protein, 25 aa, Homo sapiens
GTTGACCTACTGTTATGGTGTAACA

SEQ ID NO: 588 - protein, 25 aa, Homo sapiens
CACCTACTGGTGTAACGTGTTCGTT

SEQ ID NO: 589 - protein, 25 aa, Homo sapiens
AAAATTTTTCACAGTCACCTACTGG

SEQ ID NO: 590 - protein, 25 aa, Homo sapiens
TCGTTGTATGACACTTTCGGACCGT

SEQ ID NO: 591 - protein, 25 aa, Homo sapiens
CACCCAGATAACCTAATTGACGGAG

SEQ ID NO: 592 - protein, 25 aa, Homo sapiens
ATGGACACACAGTAACGTATAAAGG

SEQ ID NO: 593 - protein, 25 aa, Homo sapiens
GGAAATCATTCCGTACTCTCTAAGT

SEQ ID NO: 594 - protein, 25 aa, Homo sapiens
AGATCTCAGACAAGGACACACATGG

SEQ ID NO: 595 - protein, 25 aa, Homo sapiens
TCGGGTTTCTTTTGAGCCTCTGAAC

SEQ ID NO: 596 - protein, 25 aa, Homo sapiens
TCTCGGGTTTCTTTTGAGCCTCTGA

SEQ ID NO: 597 - protein, 25 aa, Homo sapiens
TAGCTCCCCAGACCTGCGTGTCTTG

SEQ ID NO: 598 - protein, 25 aa, Homo sapiens
TCGGTTCTGGTAGCTCCCCAGACCT

SEQ ID NO: 599 - protein, 25 aa, Homo sapiens
CTGGTAGCTCCCCAGACCTGCGTGT

SEQ ID NO: 600 - protein, 25 aa, Homo sapiens
GTTCTGGTAGCTCCCCAGACCTGCG

SEQ ID NO: 601 - protein, 25 aa, Homo sapiens
CTGTCCGGTACCGTCCGATGTGACT

SEQ ID NO: 602 - protein, 25 aa, Homo sapiens
CCCCGTACGTGCTATGGACCATAGT

SEQ ID NO: 603 - protein, 25 aa, Homo sapiens
GTAGACCCGGTGAGACACTAGAAAC

SEQ ID NO: 604 - protein, 25 aa, Homo sapiens
TGTCGGGAGTATGACCCTGATTAAC

SEQ ID NO: 605 - protein, 25 aa, Homo sapiens
GGTACTACACAGACAAAGGCACCTC

SEQ ID NO: 606 - protein, 25 aa, Homo sapiens
GGGTCCCACTACTAACCCTGTGTCT

SEQ ID NO: 607 - protein, 25 aa, Homo sapiens
AGACATCACCCGGTACTACACAGAC

SEQ ID NO: 608 - protein, 25 aa, Homo sapiens
AACCCTGTGTCTAGGACTGAAACAC

SEQ ID NO: 609 - protein, 25 aa, Homo sapiens
TCGGCCCGCGAATCTTGTCTCCGAA

SEQ ID NO: 610 - protein, 25 aa, Homo sapiens
CGAATCTTGTCTCCGAACGTGTCCA

SEQ ID NO: 611 - protein, 25 aa, Homo sapiens
CGTCGTCGAGTCAAAGAGTGAGGCT

SEQ ID NO: 612 - protein, 25 aa, Homo sapiens
GTCAAAGAGTGAGGCTTCACCGTCG

SEQ ID NO: 613 - DNA, 25 bp, Homo sapiens
ccccgacgtcttactgtttgcacag

SEQ ID NO: 614 - protein, 25 aa, Homo sapiens
TGCGTAAAACACAAGGTCAAATTAT

SEQ ID NO: 615 - protein, 25 aa, Homo sapiens
GACGAAAACAACTACCGAGTAAAAC

SEQ ID NO: 616 - protein, 25 aa, Homo sapiens
AGCCTCACGGTCAGTGACGAAACCT

SEQ ID NO: 617 - protein, 25 aa, Homo sapiens
ATCTTTGCGGGACGATCTGACTAAA

SEQ ID NO: 618 - protein, 25 aa, Homo sapiens
GACCTCATACAGTCTAGGACGAAAT

SEQ ID NO: 619 - protein, 25 aa, Homo sapiens
TTCGGGCTGCGTCAACGATTTTTAG

SEQ ID NO: 620 - protein, 25 aa, Homo sapiens
ACAAGTGGACACCATAGGAACTGAC

SEQ ID NO: 621 - protein, 25 aa, Homo sapiens
GATTTGACTCACACGGGACATTAGG

SEQ ID NO: 622 - protein, 25 aa, Homo sapiens
GGGTCACGGGAATTACCTACAATAC

SEQ ID NO: 623 - protein, 25 aa, Homo sapiens
GGGATGGTAACACTCGTCAATGACA

SEQ ID NO: 624 - protein, 25 aa, Homo sapiens
ACGACCGGCGAACCAAGATACTAAT

SEQ ID NO: 625 - protein, 25 aa, Homo sapiens
ACGACCGGCGAACCAAGATACTAAT

SEQ ID NO: 626 - protein, 25 aa, Homo sapiens
AACATTAAGCCGAAAGAACTTCTAT

SEQ ID NO: 627 - protein, 25 aa, Homo sapiens
TCAAAGTGATAGAAGCAAAGGTCAT

SEQ ID NO: 628 - protein, 25 aa, Homo sapiens
TAGACTAAGAATGCCAAATGAATGT

SEQ ID NO: 629 - protein, 25 aa, Homo sapiens
GGGTGTCACCATGGTACTCTACAGT

SEQ ID NO: 630 - protein, 25 aa, Homo sapiens
CGGACTGCCGAATCTTGAAACTGAT

SEQ ID NO: 631 - protein, 25 aa, Homo sapiens
ACAGTTGAACGGGACGAAACACCAG

SEQ ID NO: 632 - protein, 25 aa, Homo sapiens
CCAGTTACCACAACTCGGCGAGTAT

SEQ ID NO: 633 - protein, 25 aa, Homo sapiens
CACAATGAGGTTCACCGGTCAAAAT

SEQ ID NO: 634 - protein, 25 aa, Homo sapiens
AGACTTGTCGCCATGTCCTTACTCT

SEQ ID NO: 635 - protein, 25 aa, Homo sapiens
CGTTCGTTGTATTCTCGTTCCACAG

SEQ ID NO: 636 - protein, 25 aa, Homo sapiens
AATGACGAGTTACACATTACAACCT

SEQ ID NO: 637 - protein, 25 aa, Homo sapiens
AGGAATGAAGTTAGGGGCGAGAGCC

SEQ ID NO: 638 - protein, 25 aa, Homo sapiens
AATGAAGTTAGGGGCGAGAGCCGTC

SEQ ID NO: 639 - protein, 25 aa, Homo sapiens
CAGGAATGAAGTTAGGGGCGAGAGC

SEQ ID NO: 640 - protein, 25 aa, Homo sapiens
GGAATGAAGTTAGGGGCGAGAGCCG

SEQ ID NO: 641 - protein, 25 aa, Homo sapiens
ACTACGGATTGTCCTCTTTATACAT

SEQ ID NO: 642 - protein, 25 aa, Homo sapiens
CAAATTCTACTACGGATTGTCCTCT

SEQ ID NO: 643 - protein, 25 aa, Homo sapiens
AGTCTCGACCCAGTTGCCGCCCGGT

SEQ ID NO: 644 - protein, 25 aa, Homo sapiens
TTCTACTACGGATTGTCCTCTTTAT

SEQ ID NO: 645 - protein, 25 aa, Homo sapiens
GTTCCCTTCTTAGTACGGTTCTCCG

SEQ ID NO: 646 - protein, 25 aa, Homo sapiens
ACACCGAGTCCGAGTGATAGTTCCC

SEQ ID NO: 647 - protein, 25 aa, Homo sapiens
CCGAGTGATAGTTCCCTTCTTAGTA

SEQ ID NO: 648 - protein, 25 aa, Homo sapiens
TTCTTAGTACGGTTCTCCGACGCCG

SEQ ID NO: 649 - protein, 25 aa, Homo sapiens
GGCTCACTAGGACCGGTGCCTCTTA

SEQ ID NO: 650 - protein, 25 aa, Homo sapiens
TAGGACCGGTGCCTCTTACTAATGA

SEQ ID NO: 651 - protein, 25 aa, Homo sapiens
GAAATTCGGTCCTCCGGCTCACTAG

SEQ ID NO: 652 - protein, 25 aa, Homo sapiens
CTCCGGCTCACTAGGACCGGTGCCT

SEQ ID NO: 653 - protein, 25 aa, Homo sapiens
CACCAGCTCGGACGTCGATGAGGTC

SEQ ID NO: 654 - protein, 25 aa, Homo sapiens
TCGTTACACCAGCTCGGACGTCGAT

SEQ ID NO: 655 - protein, 25 aa, Homo sapiens
GTTACACCAGCTCGGACGTCGATGA

SEQ ID NO: 656 - protein, 25 aa, Homo sapiens
TACTCGTTACACCAGCTCGGACGTC

SEQ ID NO: 657 - protein, 25 aa, Homo sapiens
CATTCTTTGAGGCTTTAATGATACG

SEQ ID NO: 658 - protein, 25 aa, Homo sapiens
CTTTGAGGCTTTAATGATACGTCGT

SEQ ID NO: 659 - protein, 25 aa, Homo sapiens
AGGCTTTAATGATACGTCGTTTATC

SEQ ID NO: 660 - protein, 25 aa, Homo sapiens
TAGTACCATTCTTTGAGGCTTTAAT

SEQ ID NO: 661 - protein, 25 aa, Homo sapiens
CATGACGTTTGAGACGTTACAGTGG

SEQ ID NO: 662 - protein, 25 aa, Homo sapiens
GAGACGTTACAGTGGAACTTGAGAC

SEQ ID NO: 663 - protein, 25 aa, Homo sapiens
TTACAGTGGAACTTGAGACGTGTCG

SEQ ID NO: 664 - protein, 25 aa, Homo sapiens
CGTTTGAGACGTTACAGTGGAACTT

SEQ ID NO: 665 - protein, 25 aa, Homo sapiens
GAAAACCCGTCCTCCGAAGGAACGG

SEQ ID NO: 666 - protein, 25 aa, Homo sapiens
TACTAGGAGAACGTTGTGCGGCACG

SEQ ID NO: 667 - protein, 25 aa, Homo sapiens
AAGGAACGGAGAACGTCCCCTTCTT

SEQ ID NO: 668 - protein, 25 aa, Homo sapiens
CAGTCACCGGTGGTCCAGATGTCCT

SEQ ID NO: 669 - protein, 25 aa, Homo sapiens
AGAGTAGTGGGTGACCTAATACGGG

SEQ ID NO: 670 - protein, 25 aa, Homo sapiens
AGTAGTGGGTGACCTAATACGGGGT

SEQ ID NO: 671 - protein, 25 aa, Homo sapiens
AAGAGTAGTGGGTGACCTAATACGG

SEQ ID NO: 672 - protein, 25 aa, Homo sapiens
GTAGTGGGTGACCTAATACGGGGTC

SEQ ID NO: 673 - protein, 25 aa, Homo sapiens
GCACTACCGTAGGTATGGCCCAACT

SEQ ID NO: 674 - protein, 25 aa, Homo sapiens
TAGACACGCACGTCGACGGAACCGG

SEQ ID NO: 675 - protein, 25 aa, Homo sapiens
CCCCTAAGGTAGGAAGCACTACCGT

SEQ ID NO: 676 - protein, 25 aa, Homo sapiens
GTCCACCTAGTAGACACGCACGTCG

SEQ ID NO: 677 - protein, 25 aa, Homo sapiens
GGAGGTGCACTGTCCCGAACGCGAC

SEQ ID NO: 678 - protein, 25 aa, Homo sapiens
TCGCCAAGGAAAGGCTACGAGAAAG

SEQ ID NO: 679 - protein, 25 aa, Homo sapiens
GCACTGTCCCGAACGCGACGAAGAT

SEQ ID NO: 680 - protein, 25 aa, Homo sapiens
CCCTGATCGCCAAGGAAAGGCTACG

SEQ ID NO: 681 - protein, 25 aa, Homo sapiens
GCCGCGCCTCTGACGGCCGCGCAGG

SEQ ID NO: 682 - protein, 25 aa, Homo sapiens
GCGCCTCTGACGGCCGCGCAGGGCC

SEQ ID NO: 683 - protein, 25 aa, Homo sapiens
CCAGCCCAACCTGACTGAAAACTGT

SEQ ID NO: 684 - protein, 25 aa, Homo sapiens
CGCCGGCCGCCTCTTTCAACGAGGC

SEQ ID NO: 685 - protein, 25 aa, Homo sapiens
ACTGAAAACTGTCAGTCGGAAGCCG

SEQ ID NO: 686 - protein, 25 aa, Homo sapiens
AACTGTCAGTCGGAAGCCGACGCCT

SEQ ID NO: 687 - protein, 25 aa, Homo sapiens
GTGTACGCGTCACCGCTGCGGCTCG

SEQ ID NO: 688 - protein, 25 aa, Homo sapiens
GTTACAAACCTAGGGTTACTGACCT

SEQ ID NO: 689 - protein, 25 aa, Homo sapiens
AATTGGCGGTTGGTCGTCCGATTCC

SEQ ID NO: 690 - protein, 25 aa, Homo sapiens
CTACTTTCAACGTTTTCGAGACGGG

SEQ ID NO: 691 - protein, 25 aa, Homo sapiens
TTCATAGATATCTGTGTCTGTGAAC

SEQ ID NO: 692 - protein, 25 aa, Homo sapiens
AACAAACCAGAAATCCGGACGCCTC

SEQ ID NO: 693 - protein, 25 aa, Homo sapiens
CGCCTCCCCGCAATAGACCTCCCGG

SEQ ID NO: 694 - protein, 25 aa, Homo sapiens
GAGACCCGCGACAACAAACCAGAAA

SEQ ID NO: 695 - protein, 25 aa, Homo sapiens
CGGCGCCCACGTCCGGCGTCACTGT

SEQ ID NO: 696 - protein, 25 aa, Homo sapiens
ACACAAGCGCCGGACGTCCGGGTTG

SEQ ID NO: 697 - protein, 25 aa, Homo sapiens
GCTGCCGCTCTGACTGTTTGTGACC

SEQ ID NO: 698 - protein, 25 aa, Homo sapiens
GTGGCGGCCCTAAAAAACGAAGCGT

SEQ ID NO: 699 - protein, 25 aa, Homo sapiens
AAAAGGTACCGGACCCGCTTGGTGC

SEQ ID NO: 700 - protein, 25 aa, Homo sapiens
GCGACGGAGGCGATCGTGCCTACTT

SEQ ID NO: 701 - protein, 25 aa, Homo sapiens
TTTTATGAATCATACCGACTTCCGT

SEQ ID NO: 702 - protein, 25 aa, Homo sapiens
AGTTTCACTGTCTACGAGGTTGGAT

SEQ ID NO: 703 - protein, 25 aa, Homo sapiens
TGTTGTTCTCTACTTGACCAACGGT

SEQ ID NO: 704 - protein, 25 aa, Homo sapiens
CTGTCTACGAGGTTGGATATGTTGT

SEQ ID NO: 705 - protein, 25 aa, Homo sapiens
TTTTCTCCCTATAGCTCATCGTTAC

SEQ ID NO: 706 - protein, 25 aa, Homo sapiens
CTTTTCTCCCTATAGCTCATCGTTA

SEQ ID NO: 707 - protein, 25 aa, Homo sapiens
CCATCTTCTCGGTAGGTTTTTTGCT

SEQ ID NO: 708 - protein, 25 aa, Homo sapiens
CATCTTCTCGGTAGGTTTTTTGCTC

SEQ ID NO: 709 - protein, 25 aa, Homo sapiens
ATCTTCTCGGTAGGTTTTTTGCTCA

SEQ ID NO: 710 - protein, 25 aa, Homo sapiens
TCTTCTCGGTAGGTTTTTTGCTCAA

SEQ ID NO: 711 - protein, 25 aa, Homo sapiens
ACCTCTAGCTAGACAAAGGTCGGTT

SEQ ID NO: 712 - protein, 25 aa, Homo sapiens
GGAGACGGTTCTGTCTTGCACGTAG

SEQ ID NO: 713 - protein, 25 aa, Homo sapiens
GACCGTAGAGGTCAGTCTTATCGAG

SEQ ID NO: 714 - protein, 25 aa, Homo sapiens
AAGTTGCACATATCCCAGCCGGTAG

SEQ ID NO: 715 - protein, 25 aa, Homo sapiens
GGTTTGGATCAAGTCTCTGTCGAAG

SEQ ID NO: 716 - protein, 25 aa, Homo sapiens
CCGTGTAGGAATGACTGAGGGTTCT

SEQ ID NO: 717 - protein, 25 aa, Homo sapiens
CGTCTTCGAGGTCTATTTGTGCCAA

SEQ ID NO: 718 - protein, 25 aa, Homo sapiens
CGAGTCTCTAGCTCCACGGGAACAA

SEQ ID NO: 719 - protein, 25 aa, Homo sapiens
TGAAGGAATCGTTCACACAGGGTCA

SEQ ID NO: 720 - protein, 25 aa, Homo sapiens
GTCAACCGAAGATTCTCATCAAGAG

SEQ ID NO: 721 - protein, 25 aa, Homo sapiens
GAGGGTCTGGTCACCTAGAGACCAA

SEQ ID NO: 722 - protein, 25 aa, Homo sapiens
CAAGAGTCTGATCGTGGAGTGTCAA

SEQ ID NO: 723 - protein, 25 aa, Homo sapiens
GGAACTACTTCTTAGCTCCGGACAT

SEQ ID NO: 724 - protein, 25 aa, Homo sapiens
GTTCAGACACATAAACCCGTGACCG

SEQ ID NO: 725 - protein, 25 aa, Homo sapiens
GTACCTCTCGAGGATTTACGTCGAT

SEQ ID NO: 726 - protein, 25 aa, Homo sapiens
CCACCGAAATCAGGGTTACACTTAG

SEQ ID NO: 727 - protein, 25 aa, Homo sapiens
CCATACGTAATCGTCGTATAATCAT

SEQ ID NO: 728 - protein, 25 aa, Homo sapiens
ACACATCAAGCCATCTCAGGATTTT

SEQ ID NO: 729 - protein, 25 aa, Homo sapiens
GATCAAGAGAAGTGTGTCATCGTCA

SEQ ID NO: 730 - protein, 25 aa, Homo sapiens
CATAATTCAACAGATGGTACAAAAG

SEQ ID NO: 731 - protein, 25 aa, Homo sapiens
AGTGGTACTGAAACTGGCGACTTCT

SEQ ID NO: 732 - protein, 25 aa, Homo sapiens
GTGTCATAAACTTACAAACTTTCAG

SEQ ID NO: 733 - protein, 25 aa, Homo sapiens
ACAACGGGCATTACAACTTGCACAG

SEQ ID NO: 734 - protein, 25 aa, Homo sapiens
ACACTGATGATAATTGTCTAACTAA

SEQ ID NO: 735 - protein, 25 aa, Homo sapiens
AGATTATAGGCTTTGATTTATGAAC

SEQ ID NO: 736 - DNA, 25 bp, Homo sapiens
ataaagattataggctttgatttat

SEQ ID NO: 737 - protein, 25 aa, Homo sapiens
TATAGGCTTTGATTTATGAACTAAA

SEQ ID NO: 738 - protein, 25 aa, Homo sapiens
GATTATAGGCTTTGATTTATGAACT

SEQ ID NO: 739 - protein, 25 aa, Homo sapiens
CCTGGTCTTGGTCCTTATGATATAG

SEQ ID NO: 740 - protein, 25 aa, Homo sapiens
TCGTCCGACCAACCGTATTATACAT

SEQ ID NO: 741 - protein, 25 aa, Homo sapiens
CCCGAGACAAATGTAGATATGTAAA

SEQ ID NO: 742 - protein, 25 aa, Homo sapiens
CCACAGATGTCAGGTCTACAAGAAG

SEQ ID NO: 743 - protein, 25 aa, Homo sapiens
AATCAGTACCGTCTACCTCGGATGG

SEQ ID NO: 744 - protein, 25 aa, Homo sapiens
TACCGTCTACCTCGGATGGTTCTTC

SEQ ID NO: 745 - protein, 25 aa, Homo sapiens
AAGAAGTAAATCAGTACCGTCTACC

SEQ ID NO: 746 - protein, 25 aa, Homo sapiens
GTCGTAGAAATACGGTTCTAAGAAG

SEQ ID NO: 747 - protein, 25 aa, Homo sapiens
CTTACGCTATCACAGAAATTGGTAA

SEQ ID NO: 748 - protein, 25 aa, Homo sapiens
CTTTTTAAGAAACTCCAAATACTCT

SEQ ID NO: 749 - protein, 25 aa, Homo sapiens
CACTTACACTTACGCTATCACAGAA

SEQ ID NO: 750 - protein, 25 aa, Homo sapiens
AATTGGTAAATCTCCTTGACTCTGA

SEQ ID NO: 751 - protein, 25 aa, Homo sapiens
ACGTCCGGAGCTACCTTGTCAATGA

SEQ ID NO: 752 - protein, 25 aa, Homo sapiens
ATGAATCCCTTGTTGGACCACTTCT

SEQ ID NO: 753 - protein, 25 aa, Homo sapiens
ACTTTCACGGGACTTGCTTCTTACC

SEQ ID NO: 754 - protein, 25 aa, Homo sapiens
TGTGTCTAAATGTTCTCGACGTCCG

SEQ ID NO: 755 - protein, 25 aa, Homo sapiens
CTCTACAAGCAGTTCTGTTAGAACT

SEQ ID NO: 756 - protein, 25 aa, Homo sapiens
GACAAGTCTTGGGAATACCTACAAG

SEQ ID NO: 757 - protein, 25 aa, Homo sapiens
TGGGAATACCTACAAGGGTGGCATC

SEQ ID NO: 758 - protein, 25 aa, Homo sapiens
GAGAGTTTCGACAAGTCTTGGGAAT

SEQ ID NO: 759 - protein, 25 aa, Homo sapiens
TCTTGGGAATACCTACAAGGGTGGC

SEQ ID NO: 760 - protein, 25 aa, Homo sapiens
CCTTGGTTACTAAGAGTCGTGAGAT

SEQ ID NO: 761 - protein, 25 aa, Homo sapiens
GTCAAGTCACAAGTGGTCTTCTTAG

SEQ ID NO: 762 - protein, 25 aa, Homo sapiens
GGAACGACTAACCTGAAAGTTGACC

SEQ ID NO: 763 - protein, 25 aa, Homo sapiens
ACGTAAAGCTAGAGTGAGCGTAAAT

SEQ ID NO: 764 - protein, 25 aa, Homo sapiens
GTTCTCGGTTCACCTTGTTTGTTTC

SEQ ID NO: 765 - protein, 25 aa, Homo sapiens
CTACTCTCGAACGGTACGTGATAAT

SEQ ID NO: 766 - protein, 25 aa, Homo sapiens
CTCTCGAACGGTACGTGATAATGAC

SEQ ID NO: 767 - protein, 25 aa, Homo sapiens
ACTCTCGAACGGTACGTGATAATGA

SEQ ID NO: 768 - protein, 25 aa, Homo sapiens
CAACTAAGAGGACAACTCTGTTTTT

SEQ ID NO: 769 - protein, 25 aa, Homo sapiens
ATTTGGGTAGTCGATAACAACTAAG

SEQ ID NO: 770 - protein, 25 aa, Homo sapiens
ACAACTCTGTTTTTCAGGGCTCAAG

SEQ ID NO: 771 - protein, 25 aa, Homo sapiens
GGGCTCAAGTCACTCCGTAGAGGTG

SEQ ID NO: 772 - protein, 25 aa, Homo sapiens
GCTGTCTAAGACAAGATTTCTATGA

SEQ ID NO: 773 - protein, 25 aa, Homo sapiens
TTAATCCAGGATTACCTAGAGGTTC

SEQ ID NO: 774 - protein, 25 aa, Homo sapiens
CCCTTTTCAGGCTGTCTAAGACAAG

SEQ ID NO: 775 - protein, 25 aa, Homo sapiens
CCTCTTCGACTTGATGTTGAAGTCT

SEQ ID NO: 776 - protein, 25 aa, Homo sapiens
GGAGACCTACTCAATTGTGATCTAT

SEQ ID NO: 777 - protein, 25 aa, Homo sapiens
ATCTATGTAGGAAGAGATGTTGACT

SEQ ID NO: 778 - protein, 25 aa, Homo sapiens
ACTCAATTGTGATCTATGTAGGAAG

SEQ ID NO: 779 - protein, 25 aa, Homo sapiens
CAGTTGAACACTAAGGAGACCTACT

SEQ ID NO: 780 - protein, 25 aa, Homo sapiens
CTTTATGAAGCATCTAATTTACTTT

SEQ ID NO: 781 - protein, 25 aa, Homo sapiens
TAGACTAGCGTTCTTCACCCTCCGT

SEQ ID NO: 782 - protein, 25 aa, Homo sapiens
TCGCTCTTTATGAAGCATCTAATTT

SEQ ID NO: 783 - protein, 25 aa, Homo sapiens
TTTAGTCAAAGTAGACTAGCGTTCT

SEQ ID NO: 784 - protein, 25 aa, Homo sapiens
ACTATGGGCCCTTTGAAGTCTTCTC

SEQ ID NO: 785 - protein, 25 aa, Homo sapiens
TGACTATGGGCCCTTTGAAGTCTTC

SEQ ID NO: 786 - protein, 25 aa, Homo sapiens
GGGCCCTTTGAAGTCTTCTCTACGT

SEQ ID NO: 787 - protein, 25 aa, Homo sapiens
CCTTTGAAGTCTTCTCTACGTTTTC

SEQ ID NO: 788 - protein, 25 aa, Homo sapiens
TTCGTTGTCTACTCTAGACAATAAA

SEQ ID NO: 789 - protein, 25 aa, Homo sapiens
TCGTTGTCTACTCTAGACAATAAAG

SEQ ID NO: 790 - protein, 25 aa, Homo sapiens
GAGGTAGTTTCGTTGTCTACTCTAG

SEQ ID NO: 791 - protein, 25 aa, Homo sapiens
GGTAGTTTCGTTGTCTACTCTAGAC

SEQ ID NO: 792 - protein, 25 aa, Homo sapiens
CGACGACATGATTTTCTTGTTGATC

SEQ ID NO: 793 - protein, 25 aa, Homo sapiens
GCACGACGACATGATTTTCTTGTTG

SEQ ID NO: 794 - protein, 25 aa, Homo sapiens
ACGTGCACGACGACATGATTTTCTT

SEQ ID NO: 795 - protein, 25 aa, Homo sapiens
TTACGTGCACGACGACATGATTTTC

SEQ ID NO: 796 - protein, 25 aa, Homo sapiens
CTCCGCGTTTTTTTAGCTTAGTGAC

SEQ ID NO: 797 - protein, 25 aa, Homo sapiens
ACTGTACTCCGCGTTTTTTTAGCTT

SEQ ID NO: 798 - protein, 25 aa, Homo sapiens
CGCGTTTTTTTAGCTTAGTGACTTC

SEQ ID NO: 799 - protein, 25 aa, Homo sapiens
GTACTCCGCGTTTTTTTAGCTTAGT

SEQ ID NO: 800 - protein, 25 aa, Homo sapiens
CGTCGATACATACCTCCGTCCGGGT

SEQ ID NO: 801 - protein, 25 aa, Homo sapiens
TGGACCGTCGATACATACCTCCGTC

SEQ ID NO: 802 - protein, 25 aa, Homo sapiens
TACATACCTCCGTCCGGGTCGAGAA

SEQ ID NO: 803 - protein, 25 aa, Homo sapiens
ACGTTTTGGACCGTCGATACATACC

SEQ ID NO: 804 - protein, 25 aa, Homo sapiens
TACGGGTCGGTCTTACCTACATGAT

SEQ ID NO: 805 - protein, 25 aa, Homo sapiens
CCACGGAGGCATATAGAAGTATCAA

SEQ ID NO: 806 - protein, 25 aa, Homo sapiens
AATCTCGCTAAACCCCAAGTGTCGT

SEQ ID NO: 807 - protein, 25 aa, Homo sapiens
GTGACCGAAAAGAGTGAATGATTAT

SEQ ID NO: 808 - protein, 25 aa, Homo sapiens
TATCGAATCATGGATGTGAAACACC

SEQ ID NO: 809 - protein, 25 aa, Homo sapiens
AAGACTCCACGTTTAAACCGGGAAC

SEQ ID NO: 810 - protein, 25 aa, Homo sapiens
GAACCCATGTTATTAAAAGACTCCA

SEQ ID NO: 811 - protein, 25 aa, Homo sapiens
AACCGGGAACTAATGAGACTTTCGT

SEQ ID NO: 812 - protein, 25 aa, Homo sapiens
AATGGTACGGTAAAAACTGGTTTAC

SEQ ID NO: 813 - protein, 25 aa, Homo sapiens
CCCTGATATCGAGGTAGTAGAAAAA

SEQ ID NO: 814 - protein, 25 aa, Homo sapiens
GTAGAAAAAGAAGAGCTCCTGTCAT

SEQ ID NO: 815 - protein, 25 aa, Homo sapiens
ATATACCAGCTCCAGAAGGTCTTTC

SEQ ID NO: 816 - protein, 25 aa, Homo sapiens
ACCTTTCTTATTTATCCCGGTCCCT

SEQ ID NO: 817 - protein, 25 aa, Homo sapiens
GTTCCTACCTCTTTACACGATTCAC

SEQ ID NO: 818 - protein, 25 aa, Homo sapiens
TATTTATCCCGGTCCCTTGTTCCTA

SEQ ID NO: 819 - protein, 25 aa, Homo sapiens
TACCTCTTTACACGATTCACGACCA

SEQ ID NO: 820 - protein, 25 aa, Homo sapiens
GTCTCTTCTCTCACTTATGACCTCT

SEQ ID NO: 821 - protein, 25 aa, Homo sapiens
CTCTTCTCTCACTTATGACCTCTTC

SEQ ID NO: 822 - protein, 25 aa, Homo sapiens
TCTCTTCTCTCACTTATGACCTCTT

SEQ ID NO: 823 - protein, 25 aa, Homo sapiens
ACTAGTACAATGTATGGTACACAAT

SEQ ID NO: 824 - protein, 25 aa, Homo sapiens
TCGGAATGTCCTCAGTATTTTTCAG

SEQ ID NO: 825 - protein, 25 aa, Homo sapiens
CCTTACAGGAGGAAGACACAAAATG

SEQ ID NO: 826 - protein, 25 aa, Homo sapiens
AAACTCGTTGGATTCGTCTCGGTAA

SEQ ID NO: 827 - protein, 25 aa, Homo sapiens
CCTTATGGAAATCGTATATTCTTTA

SEQ ID NO: 828 - protein, 25 aa, Homo sapiens
CGGACGGCGATTTATACCTTATGGA

SEQ ID NO: 829 - protein, 25 aa, Homo sapiens
ATACCTTATGGAAATCGTATATTCT

SEQ ID NO: 830 - protein, 25 aa, Homo sapiens
TTTCGGACGGCGATTTATACCTTAT

SEQ ID NO: 831 - protein, 25 aa, Homo sapiens
CGAAGTCCTGTTTTGAGCTAAAGAC

SEQ ID NO: 832 - protein, 25 aa, Homo sapiens
GAGCTAAAGACAATACGGACGAGTC

SEQ ID NO: 833 - protein, 25 aa, Homo sapiens
CCTGTTTTGAGCTAAAGACAATACG

SEQ ID NO: 834 - protein, 25 aa, Homo sapiens
TGGTCGAAGTCCTGTTTTGAGCTAA

SEQ ID NO: 835 - protein, 25 aa, Homo sapiens
AAGCTTCAAACCTAGTGTCGGATAT

SEQ ID NO: 836 - protein, 25 aa, Homo sapiens
AAAAGCTTCAAACCTAGTGTCGGAT

SEQ ID NO: 837 - protein, 25 aa, Homo sapiens
TGTAAAAGCTTCAAACCTAGTGTCG

SEQ ID NO: 838 - protein, 25 aa, Homo sapiens
TTCAAACCTAGTGTCGGATATGGTC

SEQ ID NO: 839 - protein, 25 aa, Homo sapiens
TTGGACCATGACTTCTATTATAGAC

SEQ ID NO: 840 - protein, 25 aa, Homo sapiens
GACACAGAAACGTAATAAGGATACT

SEQ ID NO: 841 - protein, 25 aa, Homo sapiens
AAGGATACTAGAGGCGTCAAACCAC

SEQ ID NO: 842 - protein, 25 aa, Homo sapiens
GATCCCTATCTGGTAGTCAGTTGAG

SEQ ID NO: 843 - protein, 25 aa, Homo sapiens
ACTCGACACATGTGAATTTGTACGA

SEQ ID NO: 844 - protein, 25 aa, Homo sapiens
TACTCGACACATGTGAATTTGTACG

SEQ ID NO: 845 - protein, 25 aa, Homo sapiens
AACCTTAACGATCTCAAGAATTATC

SEQ ID NO: 846 - protein, 25 aa, Homo sapiens
CCTCTAAAACCTTAACGATCTCAAG

SEQ ID NO: 847 - protein, 25 aa, Homo sapiens
GATTTCTACCTTGTCATGTTGAACC

SEQ ID NO: 848 - protein, 25 aa, Homo sapiens
CTACCTTGTCATGTTGAACCTCTAA

SEQ ID NO: 849 - protein, 25 aa, Homo sapiens
CCGGGACTTTGTACATGTACTATCT

SEQ ID NO: 850 - protein, 25 aa, Homo sapiens
AGAAGTAGCTCTGTAATTTAGAGTC

SEQ ID NO: 851 - protein, 25 aa, Homo sapiens
AAAACCTGACCAAACATGTCTATAC

SEQ ID NO: 852 - protein, 25 aa, Homo sapiens
CTTTTTAAGAAGTAGCTCTGTAATT

SEQ ID NO: 853 - protein, 25 aa, Homo sapiens
CCTCCCCTAGACAAATTCGCTTATT

SEQ ID NO: 854 - protein, 25 aa, Homo sapiens
GTATCATTACCTAATGACACTCCCT

SEQ ID NO: 855 - protein, 25 aa, Homo sapiens
GTCTTTCCGCAAAACAAAGTTCTCC

SEQ ID NO: 856 - protein, 25 aa, Homo sapiens
TTTACCGAGAGAGATGTATCATTAC

SEQ ID NO: 857 - protein, 25 aa, Homo sapiens
CTCTTCAACGTCATAACCGTTTGTA

SEQ ID NO: 858 - protein, 25 aa, Homo sapiens
CTCTCTTCAACGTCATAACCGTTTG

SEQ ID NO: 859 - protein, 25 aa, Homo sapiens
TCTCTTCAACGTCATAACCGTTTGT

SEQ ID NO: 860 - protein, 25 aa, Homo sapiens
TCTTCAACGTCATAACCGTTTGTAC

SEQ ID NO: 861 - protein, 25 aa, Homo sapiens
ACCTCTTCATACAATCTGATGTCTT

SEQ ID NO: 862 - protein, 25 aa, Homo sapiens
AGATGTCTTCTACCGTCTGTCATAC

SEQ ID NO: 863 - protein, 25 aa, Homo sapiens
CCGTCTGTCATACAATAGTTCCTTT

SEQ ID NO: 864 - protein, 25 aa, Homo sapiens
TTCGGTAAGAACAATTTAGATGTCT

SEQ ID NO: 865 - protein, 25 aa, Homo sapiens
GTATAGACATTTCTACGGAATCTTT

SEQ ID NO: 866 - protein, 25 aa, Homo sapiens
GATCGTATAGACATTTCTACGGAAT

SEQ ID NO: 867 - protein, 25 aa, Homo sapiens
ATTTACAGATCGTATAGACATTTCT

SEQ ID NO: 868 - protein, 25 aa, Homo sapiens
ACAGATCGTATAGACATTTCTACGG

SEQ ID NO: 869 - protein, 25 aa, Homo sapiens
GGATGATTGCAGGACACAGTGACTC

SEQ ID NO: 870 - protein, 25 aa, Homo sapiens
CAGTAGTGGCAATAAGGATGATTGC

SEQ ID NO: 871 - protein, 25 aa, Homo sapiens
CGGTGTGGATCTGACTACGAATAAT

SEQ ID NO: 872 - protein, 25 aa, Homo sapiens
TTACGCCCTACCATGGAGACGAAAT

SEQ ID NO: 873 - protein, 25 aa, Homo sapiens
GACGACGACCAATCTGTCAGAACCA

SEQ ID NO: 874 - protein, 25 aa, Homo sapiens
CTCTCAGAGTCACGGGGGAAAGTCA

SEQ ID NO: 875 - protein, 25 aa, Homo sapiens
ACGGGGGAAAGTCAGACCTGACACT

SEQ ID NO: 876 - protein, 25 aa, Homo sapiens
ACGACCAATCTGTCAGAACCAAAGA

SEQ ID NO: 877 - protein, 25 aa, Homo sapiens
AATCAGGCGTAAGCGAGGTCCCAAA

SEQ ID NO: 878 - protein, 25 aa, Homo sapiens
CGTGCACCGTCAGTTCATCGAAGGG

SEQ ID NO: 879 - protein, 25 aa, Homo sapiens
TCACAGCTGGACAGAATGCCCGCAG

SEQ ID NO: 880 - protein, 25 aa, Homo sapiens
CACCGGTGATCGTTGCTGGAGACAC

SEQ ID NO: 881 - protein, 25 aa, Homo sapiens
GGATCTAGATTCGAAGAGACAGAAG

SEQ ID NO: 882 - protein, 25 aa, Homo sapiens
GTAAGTAAAGTATGTGTGACCGAGT

SEQ ID NO: 883 - protein, 25 aa, Homo sapiens
AAGTAAAGTATGTGTGACCGAGTGT

SEQ ID NO: 884 - protein, 25 aa, Homo sapiens
GGGATCTAGATTCGAAGAGACAGAA

SEQ ID NO: 885 - protein, 25 aa, Homo sapiens
AATGAAGTTCAGCAAAGACCTCTTT

SEQ ID NO: 886 - protein, 25 aa, Homo sapiens
ATGAAGTTCAGCAAAGACCTCTTTC

SEQ ID NO: 887 - protein, 25 aa, Homo sapiens
GATCCATGTTGAAAACCGTACCAAA

SEQ ID NO: 888 - protein, 25 aa, Homo sapiens
TGAAGTTCAGCAAAGACCTCTTTCA

SEQ ID NO: 889 - protein, 25 aa, Homo sapiens
GAGTAAGAGTACGATATCGGTCAAC

SEQ ID NO: 890 - protein, 25 aa, Homo sapiens
TGAGTAAGAGTACGATATCGGTCAA

SEQ ID NO: 891 - protein, 25 aa, Homo sapiens
AAAACTCCTGGGTCTACAGTTGTAG

SEQ ID NO: 892 - protein, 25 aa, Homo sapiens
CTGGGTCTACAGTTGTAGTGGTTAG

SEQ ID NO: 893 - protein, 25 aa, Homo sapiens
CTACAGTTGTAGTGGTTAGACCTTA

SEQ ID NO: 894 - protein, 25 aa, Homo sapiens
TTGTAGTGGTTAGACCTTAAACTTT

SEQ ID NO: 895 - protein, 25 aa, Homo sapiens
ACCTCTTTTCTCAGATTGGACGTTT

SEQ ID NO: 896 - protein, 25 aa, Homo sapiens
CGTTATATACACACTTCCAACCTCT

SEQ ID NO: 897 - protein, 25 aa, Homo sapiens
GACGTTTTTTTATCTGGATTGGTGA

SEQ ID NO: 898 - protein, 25 aa, Homo sapiens
CTCTATATAAAGTAGCTCTGTTTCT

SEQ ID NO: 899 - protein, 25 aa, Homo sapiens
ATTTTCAAAATTACGTGCTACATCG

SEQ ID NO: 900 - DNA, 25 bp, Homo sapiens
aactggactcacagcagatagccct

SEQ ID NO: 901 - protein, 25 aa, Homo sapiens
TCACAGCAGATAGCCCTTCCTCGGT

SEQ ID NO: 902 - protein, 25 aa, Homo sapiens
ATCGAATGGCGGTCCTTTTCCTACT

SEQ ID NO: 903 - protein, 25 aa, Homo sapiens
TTAAATAGGTCGTGTTTCGACTGTG

SEQ ID NO: 904 - protein, 25 aa, Homo sapiens
GTACACTTAAATAGGTCGTGTTTCG

SEQ ID NO: 905 - protein, 25 aa, Homo sapiens
ACACTTAAATAGGTCGTGTTTCGAC

SEQ ID NO: 906 - protein, 25 aa, Homo sapiens
ACTTAAATAGGTCGTGTTTCGACTG

SEQ ID NO: 907 - protein, 25 aa, Homo sapiens
CATACTCTAATTTCAAGCTAGGTAG

SEQ ID NO: 908 - protein, 25 aa, Homo sapiens
TCTTTCGAGGTTGGCCGTCGTTACA

SEQ ID NO: 909 - protein, 25 aa, Homo sapiens
GAGGTTGGCCGTCGTTACATACTCT

SEQ ID NO: 910 - protein, 25 aa, Homo sapiens
GCTAGGTAGGGACTAGTGATAAAAT

SEQ ID NO: 911 - protein, 25 aa, Homo sapiens
GGGTCAGAGGGGCTAGTATTCTTCT

SEQ ID NO: 912 - protein, 25 aa, Homo sapiens
ATTCGGATAGCATACCGGGTCAGAG

SEQ ID NO: 913 - protein, 25 aa, Homo sapiens
CAGAGGGGCTAGTATTCTTCTGAGA

SEQ ID NO: 914 - protein, 25 aa, Homo sapiens
CTAATTCGGATAGCATACCGGGTCA

SEQ ID NO: 915 - protein, 25 aa, Homo sapiens
AACCCTGATGTTTGTCGTGCGACGG

SEQ ID NO: 916 - protein, 25 aa, Homo sapiens
TTGGGTCAACGAGTCCCAGTCGGGT

SEQ ID NO: 917 - protein, 25 aa, Homo sapiens
CCTTAGGACTGTAACTTGGGTCAAC

SEQ ID NO: 918 - protein, 25 aa, Homo sapiens
GGACCTGACGGTCTAAGTATCCCAC

SEQ ID NO: 919 - protein, 25 aa, Homo sapiens
GCAGTGATCATTGTCCCACACGGAT

SEQ ID NO: 920 - protein, 25 aa, Homo sapiens
GGGACCTGTACCCATGCAAACTGCT

SEQ ID NO: 921 - protein, 25 aa, Homo sapiens
ATGGCACTCGCTGTTTCTACTAAAT

SEQ ID NO: 922 - protein, 25 aa, Homo sapiens
ATACCCGACAAGTCTCCACGTGTGG

SEQ ID NO: 923 - protein, 25 aa, Homo sapiens
ACTGGTAAAATTTGGCAACCGTTAT

SEQ ID NO: 924 - protein, 25 aa, Homo sapiens
ACAACTGGTAAAATTTGGCAACCGT

SEQ ID NO: 925 - protein, 25 aa, Homo sapiens
GTACACCACCATGCTTTTGTTAAGG

SEQ ID NO: 926 - protein, 25 aa, Homo sapiens
TGTCCGATTCCGTATGTCAAGAACT

SEQ ID NO: 927 - protein, 25 aa, Homo sapiens
GCATTGACACTTGATACCGGTATAT

SEQ ID NO: 928 - protein, 25 aa, Homo sapiens
CTGAAAAGCTTACCTGGGATACCCT

SEQ ID NO: 929 - protein, 25 aa, Homo sapiens
CGGGACTTGTACGAGAATGTTTCTA

SEQ ID NO: 930 - protein, 25 aa, Homo sapiens
AGTTACTCCTATCCTATAGATGTTG

SEQ ID NO: 931 - protein, 25 aa, Homo sapiens
TTTAGCTTACCTTATACGGGACTTG

SEQ ID NO: 932 - protein, 25 aa, Homo sapiens
ACTTCTTATGGAAGAGTGGATGTAG

SEQ ID NO: 933 - protein, 25 aa, Homo sapiens
ACGAGAAATTACTACCGTGGAAAGT

SEQ ID NO: 934 - protein, 25 aa, Homo sapiens
CGATTTTAGACTATTCCGGGATTAC

SEQ ID NO: 935 - protein, 25 aa, Homo sapiens
CACCTCTAGACGGATCACAATGACT

SEQ ID NO: 936 - protein, 25 aa, Homo sapiens
CACAATGACTATAAGCTTCTGGAGC

SEQ ID NO: 937 - protein, 25 aa, Homo sapiens
AAACATCCGTGATTGAGTGAGAGGA

SEQ ID NO: 938 - protein, 25 aa, Homo sapiens
TTGAGTGAGAGGATTAGAGAAGGTC

SEQ ID NO: 939 - protein, 25 aa, Homo sapiens
TTATTATTATCTCACGTACGATGTT

SEQ ID NO: 940 - protein, 25 aa, Homo sapiens
TGTCAAGTGATAATGCGTCTCGAAC

SEQ ID NO: 941 - protein, 25 aa, Homo sapiens
AGTTCACTGCCACGACTTTATGAAA

SEQ ID NO: 942 - protein, 25 aa, Homo sapiens
AATGCGTCTCGAACCGGTTACGAGT

SEQ ID NO: 943 - protein, 25 aa, Homo sapiens
AGGACTCGTTAAATAATCAGTTCAC

SEQ ID NO: 944 - protein, 25 aa, Homo sapiens
AAAGTCACCCAGTGGTTTACCCAAC

SEQ ID NO: 945 - protein, 25 aa, Homo sapiens
TGGCAGCCACAGGAAAAGTTGTTAC

SEQ ID NO: 946 - protein, 25 aa, Homo sapiens
AACCCATGGTCGAGAGTCTGGTGTG

SEQ ID NO: 947 - protein, 25 aa, Homo sapiens
AAGTTGTTACCACGAGTGTACTCGG

SEQ ID NO: 948 - protein, 25 aa, Homo sapiens
GTACCCTTCACAACGTCTGTGTCAC

SEQ ID NO: 949 - protein, 25 aa, Homo sapiens
CTGTGTCACCGTTCCCAAGAAGCCC

SEQ ID NO: 950 - protein, 25 aa, Homo sapiens
TCATGGTACCCTTCACAACGTCTGT

SEQ ID NO: 951 - protein, 25 aa, Homo sapiens
AACTTCTGTCATGGTACCCTTCACA

SEQ ID NO: 952 - protein, 25 aa, Homo sapiens
GTCTAACCCCTACGATAAGCCTACT

SEQ ID NO: 953 - protein, 25 aa, Homo sapiens
TCCAGACCTTGTGGGCGTCATCTTT

SEQ ID NO: 954 - protein, 25 aa, Homo sapiens
CCTACGATAAGCCTACTATCAGTCT

SEQ ID NO: 955 - protein, 25 aa, Homo sapiens
CCTTGTGGGCGTCATCTTTTGTTCG

SEQ ID NO: 956 - protein, 25 aa, Homo sapiens
TGACGCAATAGAAAATAGACCGAAC

SEQ ID NO: 957 - protein, 25 aa, Homo sapiens
ACGGAGTGAGAGTAGAATTAGACCT

SEQ ID NO: 958 - protein, 25 aa, Homo sapiens
CGAAAAACTACTCGAAAGGGTCGTT

SEQ ID NO: 959 - protein, 25 aa, Homo sapiens
CGTACGTTCACTCAAATGACGCAAT

SEQ ID NO: 960 - protein, 25 aa, Homo sapiens
CTTTTTCTGAAGTTATTGAGTCGTT

SEQ ID NO: 961 - protein, 25 aa, Homo sapiens
CTTCTGTAGATGTTCGAATCCGTAC

SEQ ID NO: 962 - protein, 25 aa, Homo sapiens
TAGATGTTCGAATCCGTACTAAACT

SEQ ID NO: 963 - protein, 25 aa, Homo sapiens
TCTGAAGTTATTGAGTCGTTGGGTC

SEQ ID NO: 964 - protein, 25 aa, Homo sapiens
GTTTCGTTCTATATAACTGTGTGTA

SEQ ID NO: 965 - protein, 25 aa, Homo sapiens
TTTCGTTCTATATAACTGTGTGTAT

SEQ ID NO: 966 - protein, 25 aa, Homo sapiens
CGACAACAGTATGTCAAGGTCTAAA

SEQ ID NO: 967 - protein, 25 aa, Homo sapiens
CAAGGTCTAAAGGTGAATAGTTCGG

SEQ ID NO: 968 - protein, 25 aa, Homo sapiens
GAATAGTTCGGGTCGATTCTTAAAG

SEQ ID NO: 969 - protein, 25 aa, Homo sapiens
GAGGCCTGTCTGACAGAAGATCGAC

SEQ ID NO: 970 - protein, 25 aa, Homo sapiens
TCGTTCCATATGTTACGGCAGGAGT

SEQ ID NO: 971 - protein, 25 aa, Homo sapiens
GGTCTCCTAGCAGGGTCAAACCTAC

SEQ ID NO: 972 - protein, 25 aa, Homo sapiens
CCTACTGTAGTAAGCTGTACTGAAA

SEQ ID NO: 973 - protein, 25 aa, Homo sapiens
CGAGGACGGTTCGTGAATTAACGAT

SEQ ID NO: 974 - protein, 25 aa, Homo sapiens
TGCTATACACCATGGGGTTTAATAG

SEQ ID NO: 975 - protein, 25 aa, Homo sapiens
ACACTTAGTCTGTAAACCCGGGACC

SEQ ID NO: 976 - protein, 25 aa, Homo sapiens
AATAGAGAGAGGACTTCAGGAGTTG

SEQ ID NO: 977 - protein, 25 aa, Homo sapiens
TTCAGGAGTTGTTTGTTCCTGTACC

SEQ ID NO: 978 - protein, 25 aa, Homo sapiens
CCGTCGGTCCGATCTTGGGAACCTT

SEQ ID NO: 979 - protein, 25 aa, Homo sapiens
CTTGAAAAAATAATTACTTCGGTAC

SEQ ID NO: 980 - protein, 25 aa, Homo sapiens
CCTGAAGCCAGACCGTCGGTCCGAT

SEQ ID NO: 981 - protein, 25 aa, Homo sapiens
TCCGATCTTGGGAACCTTGTGTCTT

SEQ ID NO: 982 - protein, 25 aa, Homo sapiens
TGCGGTTTTCGACTCAAAACACAAT

SEQ ID NO: 983 - protein, 25 aa, Homo sapiens
CATTCAGTAACTGCGGTTTTCGACT

SEQ ID NO: 984 - protein, 25 aa, Homo sapiens
GGTCTTCAAGCTATGATGGAGTCCG

SEQ ID NO: 985 - protein, 25 aa, Homo sapiens
ATGGAGTCCGTCTAACACAGACCTG

SEQ ID NO: 986 - protein, 25 aa, Homo sapiens
TTCAAGCTATGATGGAGTCCGTCTA

SEQ ID NO: 987 - protein, 25 aa, Homo sapiens
AACACAGACCTGACTTTATGGAAGT

SEQ ID NO: 988 - protein, 25 aa, Homo sapiens
CATTCACAGTTGAGGATAAACTCTT

SEQ ID NO: 989 - protein, 25 aa, Homo sapiens
TCTCATAAAATAGACCCTAAAATCG

SEQ ID NO: 990 - protein, 25 aa, Homo sapiens
GGGCTTAATTGTACCATAAGTTTCT

SEQ ID NO: 991 - protein, 25 aa, Homo sapiens
CTCTTGTAAACGAATGGGGCTTAAT

SEQ ID NO: 992 - protein, 25 aa, Homo sapiens
ACGTCAAAATGGTGATGAAGCTCCT

SEQ ID NO: 993 - protein, 25 aa, Homo sapiens
CTTTTGTAAATGTAAGAGAACCTTA

SEQ ID NO: 994 - protein, 25 aa, Homo sapiens
AAGAAGTAGTATTCGTACATCACGT

SEQ ID NO: 995 - protein, 25 aa, Homo sapiens
AGAGAACCTTATGACGTCATCTTCC

SEQ ID NO: 996 - protein, 25 aa, Homo sapiens
ACTGAGAACTCATTTCATAAAAGAA

SEQ ID NO: 997 - protein, 25 aa, Homo sapiens
CACGCATACTGAGAACTCATTTCAT

SEQ ID NO: 998 - protein, 25 aa, Homo sapiens
TTTACAGAAGACGTACACATTAGTG

SEQ ID NO: 999 - protein, 25 aa, Homo sapiens
GAAGACGTACACATTAGTGACCGAA

SEQ ID NO: 1000 - protein, 25 aa, Homo sapiens
CGTCTCATCGATTTGGAGTAGTTTC

SEQ ID NO: 1001 - protein, 25 aa, Homo sapiens
TGCGGCGTTTTTAATAAGGAGTGTC

SEQ ID NO: 1002 - protein, 25 aa, Homo sapiens
TATTGTTTCAGATGCGGCGTTTTTA

SEQ ID NO: 1003 - protein, 25 aa, Homo sapiens
AACGTTTTACAATGCTCTACTGTCT

SEQ ID NO: 1004 - protein, 25 aa, Homo sapiens
ATAGACGAGGGTCCCTTAAAAGGAC

SEQ ID NO: 1005 - protein, 25 aa, Homo sapiens
AAGTACTCCCTCGAAATTGCTTCAG

SEQ ID NO: 1006 - protein, 25 aa, Homo sapiens
CGGCAGGTAAAAACACGGTAGGAGT

SEQ ID NO: 1007 - protein, 25 aa, Homo sapiens
GAGTTAAGGCAGAGCCGAAACAAAG

SEQ ID NO: 1008 - protein, 25 aa, Homo sapiens
GGTGCTGACCCTTCGCGATGACGGC

SEQ ID NO: 1009 - protein, 25 aa, Homo sapiens
TGAGCTTCTTCTTCGCCGGCGGCGT

SEQ ID NO: 1010 - protein, 25 aa, Homo sapiens
TGGTAAGCGTGAGCCCCGGCCTCTA

SEQ ID NO: 1011 - protein, 25 aa, Homo sapiens
CCGGCCTCTAGAGCGCCTAATAGCA

SEQ ID NO: 1012 - protein, 25 aa, Homo sapiens
AGTGAGCGTGTTCACCTGGCCCCAC

SEQ ID NO: 1013 - protein, 25 aa, Homo sapiens
TCCGTTCCCACGCTCCTGGTGCCGG

SEQ ID NO: 1014 - protein, 25 aa, Homo sapiens
TGGTGCCGGCCGAGCCTGCACACTG

SEQ ID NO: 1015 - protein, 25 aa, Homo sapiens
GCTCGCGAGAGTGAGCGTGTTCACC

SEQ ID NO: 1016 - protein, 25 aa, Homo sapiens
TTTAAACTTGCCGACGTCTCCGGCT

SEQ ID NO: 1017 - protein, 25 aa, Homo sapiens
CTTTAAGTTTAAACTTGCCGACGTC

SEQ ID NO: 1018 - protein, 25 aa, Homo sapiens
ACACCCTCTCAAGGGGGCGGAGTCT

SEQ ID NO: 1019 - protein, 25 aa, Homo sapiens
GGCTCAGGCAGTGACCTTCGGCTCT

SEQ ID NO: 1020 - protein, 25 aa, Homo sapiens
TAGCAGAGCATCAGGCTGCGGACCC

SEQ ID NO: 1021 - protein, 25 aa, Homo sapiens
TGTGTGACTCGACTCTGAGTGAAAA

SEQ ID NO: 1022 - protein, 25 aa, Homo sapiens
CTTGGTGGCAAAGGTAGCAGAGCAT

SEQ ID NO: 1023 - protein, 25 aa, Homo sapiens
GGACTTAAACTTGGTGGCAAAGGTA

SEQ ID NO: 1024 - protein, 25 aa, Homo sapiens
CCTCCTTCCGAAACTCAGACAGGAT

SEQ ID NO: 1025 - protein, 25 aa, Homo sapiens
AGGATTTTCCGACAACGCTCTCCAG

SEQ ID NO: 1026 - protein, 25 aa, Homo sapiens
TCCGACAACGCTCTCCAGAAAGTCG

SEQ ID NO: 1027 - protein, 25 aa, Homo sapiens
ACTCAGACAGGATTTTCCGACAACG

SEQ ID NO: 1028 - protein, 25 aa, Homo sapiens
AGGACCGCGTCGTTCTCACTCCGCG

SEQ ID NO: 1029 - protein, 25 aa, Homo sapiens
GCCTTGCCCAGGACGACCTTCGTCG

SEQ ID NO: 1030 - protein, 25 aa, Homo sapiens
CGGGCGTCCCCTCTACGATTACTTT

SEQ ID NO: 1031 - protein, 25 aa, Homo sapiens
CACTAAACGCCTCAAGTGCGTCGGG

SEQ ID NO: 1032 - protein, 25 aa, Homo sapiens
GCTTGGGCACGGTCCGCTCTCTTAG

SEQ ID NO: 1033 - protein, 25 aa, Homo sapiens
TTGACGACCTCGCTTGGGCACGGTC

SEQ ID NO: 1034 - protein, 25 aa, Homo sapiens
GACGACCTCGCTTGGGCACGGTCCG

SEQ ID NO: 1035 - protein, 25 aa, Homo sapiens
CGGTCCGCTCTCTTAGAAGTCTCTT

SEQ ID NO: 1036 - protein, 25 aa, Homo sapiens
GTCGTCGAGGTTCCAGATACTGAGT

SEQ ID NO: 1037 - protein, 25 aa, Homo sapiens
CCAGATACTGAGTACGATTCGCTCG

SEQ ID NO: 1038 - protein, 25 aa, Homo sapiens
GAGTACGATTCGCTCGATCTGTCGG

SEQ ID NO: 1039 - protein, 25 aa, Homo sapiens
GATTCGCTCGATCTGTCGGTGAAAG

SEQ ID NO: 1040 - protein, 25 aa, Homo sapiens
TCTTTAGAACATGTTTTGGTAGCGG

SEQ ID NO: 1041 - protein, 25 aa, Homo sapiens
ACCTTTTATTTGTTGGTCAACTCAG

SEQ ID NO: 1042 - protein, 25 aa, Homo sapiens
AACAAGAGGTTCAGGACACAGAGGA

SEQ ID NO: 1043 - protein, 25 aa, Homo sapiens
AGCGGTAGTTTTTTTGCGACAAGAC

SEQ ID NO: 1044 - protein, 25 aa, Homo sapiens
TTGAACGTCTCGTTGCCGCGGCAAC

SEQ ID NO: 1045 - protein, 25 aa, Homo sapiens
CGGTGTTCGTCGTCTATGGTAGTCA

SEQ ID NO: 1046 - protein, 25 aa, Homo sapiens
CACTAAGACAACGACAGGGCCGTAG

SEQ ID NO: 1047 - protein, 25 aa, Homo sapiens
GCGGCAACCCTATTACTACTATACT

SEQ ID NO: 1048 - protein, 25 aa, Homo sapiens
ACGACGTTGATAAACGAGGACCCTT

SEQ ID NO: 1049 - protein, 25 aa, Homo sapiens
CGAAAGTTTACGGAGCCGTTGAGGT

SEQ ID NO: 1050 - protein, 25 aa, Homo sapiens
TTACGGAGCCGTTGAGGTCAACCGT

SEQ ID NO: 1051 - protein, 25 aa, Homo sapiens
GTCTTCCCCGGCAGACCGGTTAGAA

SEQ ID NO: 1052 - protein, 25 aa, Homo sapiens
CGGGATAGGAGTTCACGACTACTAC

SEQ ID NO: 1053 - protein, 25 aa, Homo sapiens
CTACCGCTACGGAGAAACTTATTTC

SEQ ID NO: 1054 - protein, 25 aa, Homo sapiens
CGGACCATGGCGAACAAATAGGTTT

SEQ ID NO: 1055 - protein, 25 aa, Homo sapiens
CACAATTCGTCCTTCGATGTAAGAC

SEQ ID NO: 1056 - protein, 25 aa, Homo sapiens
AATAGGGTCTGTCAAGGTAGGTTCC

SEQ ID NO: 1057 - protein, 25 aa, Homo sapiens
CCATAGCTTTGGTTAACACTTCAGT

SEQ ID NO: 1058 - protein, 25 aa, Homo sapiens
TCAACACTCCCTGTTTTAGGACTCG

SEQ ID NO: 1059 - protein, 25 aa, Homo sapiens
AGGTCACTTTAGATGATGTAGATAG

SEQ ID NO: 1060 - protein, 25 aa, Homo sapiens
CGAAACCTCTCGCAACAGTTCTTGT

SEQ ID NO: 1061 - protein, 25 aa, Homo sapiens
TCGGAAAGGACCTTGCGAAACCTCT

SEQ ID NO: 1062 - protein, 25 aa, Homo sapiens
GTTTCTTTCAGGTCGAGCATCGTGT

SEQ ID NO: 1063 - protein, 25 aa, Homo sapiens
GAGGTTTATGTTTCCGGTAGGTTCT

SEQ ID NO: 1064 - protein, 25 aa, Homo sapiens
CCCGTTATATACCTCACGTCTTTTT

SEQ ID NO: 1065 - protein, 25 aa, Homo sapiens
CGGCTAAACTGTTCCCGTTATATAC

SEQ ID NO: 1066 - protein, 25 aa, Homo sapiens
TCTTGATCGTACAGAAGCACCGGCT

SEQ ID NO: 1067 - protein, 25 aa, Homo sapiens
CACGTCTTTTTCCGCCTTTGAGTTT

SEQ ID NO: 1068 - protein, 25 aa, Homo sapiens
TCCACTGGCTTTTGGTCTATGGTCG

SEQ ID NO: 1069 - protein, 25 aa, Homo sapiens
AAAGTTTTTGAGTCAGTGAAGGTCA

SEQ ID NO: 1070 - protein, 25 aa, Homo sapiens
TATGGTCGGTTTTTAAGATCATGTC

SEQ ID NO: 1071 - protein, 25 aa, Homo sapiens
CAAAGTTTTTGAGTCAGTGAAGGTC

SEQ ID NO: 1072 - protein, 25 aa, Homo sapiens
GTAGTCTGGGTTTCCAACTCGTCTT

SEQ ID NO: 1073 - protein, 25 aa, Homo sapiens
AGAAGTCACTACAGGATCTCCTTCC

SEQ ID NO: 1074 - protein, 25 aa, Homo sapiens
CGTGACTTATAGAGGAGTTACAGAA

SEQ ID NO: 1075 - protein, 25 aa, Homo sapiens
CCTAGTTCGTAATCGTCTTTCGTCG

SEQ ID NO: 1076 - protein, 25 aa, Homo sapiens
AACGTGGTAACCGTGTTTGTCAACC

SEQ ID NO: 1077 - protein, 25 aa, Homo sapiens
GTGGATCTGACCTTAACTTTCTGTG

SEQ ID NO: 1078 - protein, 25 aa, Homo sapiens
CTGACCTTAACTTTCTGTGGTCGTC

SEQ ID NO: 1079 - protein, 25 aa, Homo sapiens
TCAAATCACAGGTGTGGATCTGACC

SEQ ID NO: 1080 - protein, 25 aa, Homo sapiens
AGGTGTGGATCTGACCTTAACTTTC

SEQ ID NO: 1081 - protein, 25 aa, Homo sapiens
CTTTGTCTTGCAGGTAGTTATTTCG

SEQ ID NO: 1082 - protein, 25 aa, Homo sapiens
TTGCAGGTAGTTATTTCGTCCACTA

SEQ ID NO: 1083 - protein, 25 aa, Homo sapiens
ACTAACAAGCCTTCCTTCTACAATG

SEQ ID NO: 1084 - protein, 25 aa, Homo sapiens
AAGTTTCTTTGTCTTGCAGGTAGTT

SEQ ID NO: 1085 - protein, 25 aa, Homo sapiens
TCGTCTTTCTGAAGAAGATTAACGT

SEQ ID NO: 1086 - protein, 25 aa, Homo sapiens
TGTCTGTCACTAGATAGTTCGATCG

SEQ ID NO: 1087 - protein, 25 aa, Homo sapiens
CTTGAGTTATTGCTTTATTTATACG

SEQ ID NO: 1088 - protein, 25 aa, Homo sapiens
TCGATCGGTCCGAGAATTGACGACA

SEQ ID NO: 1089 - protein, 25 aa, Homo sapiens
ACGGTAGGTTTCCTAGTCAATGAAA

SEQ ID NO: 1090 - protein, 25 aa, Homo sapiens
AGGCGAACGGAGATTTTCGTCTAAA

SEQ ID NO: 1091 - protein, 25 aa, Homo sapiens
AATGAAACAGTCTTTAGGCGAACGG

SEQ ID NO: 1092 - protein, 25 aa, Homo sapiens
GTCTAAAACAGACGTCATGCCAAGT

SEQ ID NO: 1093 - protein, 25 aa, Homo sapiens
GAGAATTGCCACTACGAGACTGTAA

SEQ ID NO: 1094 - protein, 25 aa, Homo sapiens
TACCATCGGTGTGGTAATCGTTCAT

SEQ ID NO: 1095 - protein, 25 aa, Homo sapiens
GACTGTAAGTGATGATGTAAATGAG

SEQ ID NO: 1096 - protein, 25 aa, Homo sapiens
AGTTTGAGAGAATTGCCACTACGAG

SEQ ID NO: 1097 - protein, 25 aa, Homo sapiens
TTTCTAGGGAGTCCGGAACTATTCT

SEQ ID NO: 1098 - protein, 25 aa, Homo sapiens
TTCTTTCTAGGGAGTCCGGAACTAT

SEQ ID NO: 1099 - protein, 25 aa, Homo sapiens
TCTAGGGAGTCCGGAACTATTCTTC

SEQ ID NO: 1100 - protein, 25 aa, Homo sapiens
CTTTCTAGGGAGTCCGGAACTATTC

SEQ ID NO: 1101 - protein, 25 aa, Homo sapiens
CACGACACGCTTGGTCGTTGAAGCG

SEQ ID NO: 1102 - protein, 25 aa, Homo sapiens
CCGGTCAGGTCCTCCAGAATCACGA

SEQ ID NO: 1103 - protein, 25 aa, Homo sapiens
AACCTAGAATGTGTAATAGTAACAG

SEQ ID NO: 1104 - protein, 25 aa, Homo sapiens
CGTTGAAGCGGGAACAACCTAGAAT

SEQ ID NO: 1105 - protein, 25 aa, Homo sapiens
CGCTCTCGATGACCCGATAAACAAG

SEQ ID NO: 1106 - protein, 25 aa, Homo sapiens
ATTCTCTCGCTCTCGATGACCCGAT

SEQ ID NO: 1107 - protein, 25 aa, Homo sapiens
TCGATGACCCGATAAACAAGGTCCT

SEQ ID NO: 1108 - protein, 25 aa, Homo sapiens
ATGACCCGATAAACAAGGTCCTTTT

SEQ ID NO: 1109 - protein, 25 aa, Homo sapiens
AGAATAACCTGAATAGGTCTACTAC

SEQ ID NO: 1110 - protein, 25 aa, Homo sapiens
CAAAACCACGGACCGTAGCTTCTAC

SEQ ID NO: 1111 - protein, 25 aa, Homo sapiens
GACCTTTGACATATAGAATAACCTG

SEQ ID NO: 1112 - protein, 25 aa, Homo sapiens
CCGTAGCTTCTACCACACAAGAAAG

SEQ ID NO: 1113 - protein, 25 aa, Homo sapiens
GACCCCGAGTAATATGACAACAAAC

SEQ ID NO: 1114 - protein, 25 aa, Homo sapiens
AACCGACAACCGAGTACACACGGAT

SEQ ID NO: 1115 - protein, 25 aa, Homo sapiens
ACCGTTCTCGATGGTCAACTATAAA

SEQ ID NO: 1116 - protein, 25 aa, Homo sapiens
GCATAGTATCCTTAAGTACCGACGG

SEQ ID NO: 1117 - protein, 25 aa, Homo sapiens
GTATCCTTCCTATTTAGACCGATTA

SEQ ID NO: 1118 - protein, 25 aa, Homo sapiens
CCTTCCTATTTAGACCGATTAACAT

SEQ ID NO: 1119 - protein, 25 aa, Homo sapiens
ATCCTTCCTATTTAGACCGATTAAC

SEQ ID NO: 1120 - protein, 25 aa, Homo sapiens
CCTATTTAGACCGATTAACATGGTC

SEQ ID NO: 1121 - protein, 25 aa, Homo sapiens
CACGTTCTGCGTTGTGAAAACTTAA

SEQ ID NO: 1122 - protein, 25 aa, Homo sapiens
AGGCTGGTGTTTCTCTTCTACTGGC

SEQ ID NO: 1123 - protein, 25 aa, Homo sapiens
TGGCTCTCTGAGAACAGTCGGTTAC

SEQ ID NO: 1124 - protein, 25 aa, Homo sapiens
TCGGTTACGTCCCTGTGTGAGACAC

SEQ ID NO: 1125 - protein, 25 aa, Homo sapiens
TTCTCGCCCTAGAGACCTACGTTTT

SEQ ID NO: 1126 - protein, 25 aa, Homo sapiens
ACCTACGTTTTTGAGTTAGTTCAAG

SEQ ID NO: 1127 - protein, 25 aa, Homo sapiens
TCAAGAACAACTATAAGCGGAGACC

SEQ ID NO: 1128 - protein, 25 aa, Homo sapiens
ACCGACAGACGTCTATGATTTCTTC

SEQ ID NO: 1129 - protein, 25 aa, Homo sapiens
ACGATGTTTGGATAACCTTTCGGAA

SEQ ID NO: 1130 - protein, 25 aa, Homo sapiens
CGATGTTTGGATAACCTTTCGGAAT

SEQ ID NO: 1131 - protein, 25 aa, Homo sapiens
AACGATGTTTGGATAACCTTTCGGA

SEQ ID NO: 1132 - protein, 25 aa, Homo sapiens
GACGCATCGAATGTCTGAATCGTAT

SEQ ID NO: 1133 - protein, 25 aa, Homo sapiens
ATGCTTTCCCAAACACGGTTATAAG

SEQ ID NO: 1134 - protein, 25 aa, Homo sapiens
AGAGTCATCAAAAAAGCTTTCCGAC

SEQ ID NO: 1135 - protein, 25 aa, Homo sapiens
CAGAAGAACCTCGACATCCAGAACT

SEQ ID NO: 1136 - protein, 25 aa, Homo sapiens
CGACGTCAGTGTAGGACGCGCCCAC

SEQ ID NO: 1137 - protein, 25 aa, Homo sapiens
GAGTCCAGGATCCTTCGACCCCGTG

SEQ ID NO: 1138 - protein, 25 aa, Homo sapiens
GCACTGTTCGCAGGGCCTCTTTCGG

SEQ ID NO: 1139 - protein, 25 aa, Homo sapiens
GGTCCGGAAGTCAACAAAGCCCTGC

SEQ ID NO: 1140 - protein, 25 aa, Homo sapiens
ACTTTTACCTTCAACTCGTCGAAGC

SEQ ID NO: 1141 - protein, 25 aa, Homo sapiens
TCAACTCGTCGAAGCGTTTCTTCAC

SEQ ID NO: 1142 - DNA, 25 bp, Homo sapiens
accttcaactcgtcgaagcgtttct

SEQ ID NO: 1143 - protein, 25 aa, Homo sapiens
TCGTCGAAGCGTTTCTTCACTTCAA

SEQ ID NO: 1144 - protein, 25 aa, Homo sapiens
TCTCCTAGGAGATCATTTCCCTTAA

SEQ ID NO: 1145 - protein, 25 aa, Homo sapiens
ACCTCTCCTAGGAGATCATTTCCCT

SEQ ID NO: 1146 - protein, 25 aa, Homo sapiens
CTCCTAGGAGATCATTTCCCTTAAG

SEQ ID NO: 1147 - protein, 25 aa, Homo sapiens
CCTCTCCTAGGAGATCATTTCCCTT

SEQ ID NO: 1148 - protein, 25 aa, Homo sapiens
CTGTGAAGAAAGTCATATAACGAAC

SEQ ID NO: 1149 - protein, 25 aa, Homo sapiens
CACGATGAGTAGAAACGAGTGATAC

SEQ ID NO: 1150 - protein, 25 aa, Homo sapiens
CTTGTAATGAACTCGTACTGTGAAG

SEQ ID NO: 1151 - protein, 25 aa, Homo sapiens
ACCCTCTTTGACGTAGGATTCACCT

SEQ ID NO: 1152 - protein, 25 aa, Homo sapiens
GAACCCGTACCGTGATGAGGTCAAG

SEQ ID NO: 1153 - protein, 25 aa, Homo sapiens
GAACCTGGAGACGTGAGTACGAACG

SEQ ID NO: 1154 - protein, 25 aa, Homo sapiens
CGAAACTCTCGGTCATGAATAAGGA

SEQ ID NO: 1155 - protein, 25 aa, Homo sapiens
GGAGACCTTGCACAAACTAGATTGG

SEQ ID NO: 1156 - protein, 25 aa, Homo sapiens
GTAAATAAGGCCAATGACCGTTCCG

SEQ ID NO: 1157 - protein, 25 aa, Homo sapiens
CATGTGAGGGTTCAGGATCGAAAAC

SEQ ID NO: 1158 - protein, 25 aa, Homo sapiens
GGGATTGAACAACCCTCAACGCTAA

SEQ ID NO: 1159 - protein, 25 aa, Homo sapiens
GGTCGGTTGTACATCTTCACGTTAT

SEQ ID NO: 1160 - protein, 25 aa, Homo sapiens
GAGGCATCAGCGCAGGCGAACCTCG

SEQ ID NO: 1161 - protein, 25 aa, Homo sapiens
TGGCAGGCACTCACATGCGCGGGCC

SEQ ID NO: 1162 - protein, 25 aa, Homo sapiens
GCCCGGCGAAACACTGAAGTGAGCA

SEQ ID NO: 1163 - protein, 25 aa, Homo sapiens
TGAGCAAAGCGTTGTTCGGGCCCGT

SEQ ID NO: 1164 - protein, 25 aa, Homo sapiens
CGACCCGCGTCGTGAGGCAGCCGCC

SEQ ID NO: 1165 - protein, 25 aa, Homo sapiens
ACCCGCGTCGTGAGGCAGCCGCCGC

SEQ ID NO: 1166 - protein, 25 aa, Homo sapiens
GGCGACCCGCGTCGTGAGGCAGCCG

SEQ ID NO: 1167 - protein, 25 aa, Homo sapiens
CCCGCGTCGTGAGGCAGCCGCCGCC

SEQ ID NO: 1168 - protein, 25 aa, Homo sapiens
GGAAGTAATAGAGGATGCACCAGCG

SEQ ID NO: 1169 - protein, 25 aa, Homo sapiens
TGGACCAGCAGTCGGCGGAAGTAAT

SEQ ID NO: 1170 - protein, 25 aa, Homo sapiens
GACACGAAGGACTCCCCTTACCGAA

SEQ ID NO: 1171 - protein, 25 aa, Homo sapiens
TAGAGGATGCACCAGCGGCACGAGA

SEQ ID NO: 1172 - protein, 25 aa, Homo sapiens
AAACCTAAATACTATTTGAAGAGAC

SEQ ID NO: 1173 - protein, 25 aa, Homo sapiens
AACCTAAATACTATTTGAAGAGACG

SEQ ID NO: 1174 - protein, 25 aa, Homo sapiens
AAAACCTAAATACTATTTGAAGAGA

SEQ ID NO: 1175 - protein, 25 aa, Homo sapiens
ACCTAAATACTATTTGAAGAGACGT

SEQ ID NO: 1176 - protein, 25 aa, Homo sapiens
AATTGAACCACAGAAATCACGAACC

SEQ ID NO: 1177 - protein, 25 aa, Homo sapiens
GGACGATAAAGTCGTGAGGACAAAA

SEQ ID NO: 1178 - protein, 25 aa, Homo sapiens
ATCATGTCTTCGTTTTAGTTTGGAC

SEQ ID NO: 1179 - protein, 25 aa, Homo sapiens
CGTCGGTGCTACATATGTTCTATGT

SEQ ID NO: 1180 - protein, 25 aa, Homo sapiens
ACCTCACATACACAGACTTCTCTCG

SEQ ID NO: 1181 - protein, 25 aa, Homo sapiens
CGTGTGAATACGGTAATATCGGTAA

SEQ ID NO: 1182 - protein, 25 aa, Homo sapiens
GTCAATACTCCTCACCACCTCACAT

SEQ ID NO: 1183 - protein, 25 aa, Homo sapiens
CTCCGTGTGAATACGGTAATATCGG

SEQ ID NO: 1184 - protein, 25 aa, Homo sapiens
GGGTCACCTTGTCAGAGAGCTGTAC

SEQ ID NO: 1185 - protein, 25 aa, Homo sapiens
AGACGGCAAAGAACGCGTCGACAGT

SEQ ID NO: 1186 - protein, 25 aa, Homo sapiens
CACATGTGCGAGGATGTCAGGTAGT

SEQ ID NO: 1187 - protein, 25 aa, Homo sapiens
AGAGCTGTACGGTGTATGCCTACCA

SEQ ID NO: 1188 - protein, 25 aa, Homo sapiens
GTGATTAAAGGTATTGGTTCGACCT

SEQ ID NO: 1189 - protein, 25 aa, Homo sapiens
TGATTAAAGGTATTGGTTCGACCTC

SEQ ID NO: 1190 - protein, 25 aa, Homo sapiens
GATTAAAGGTATTGGTTCGACCTCA

SEQ ID NO: 1191 - protein, 25 aa, Homo sapiens
ACTCAGAAAAAGCCGATTTAAGACA

SEQ ID NO: 1192 - protein, 25 aa, Homo sapiens
TCATACATGTAATTTCACTCAGAAA

SEQ ID NO: 1193 - protein, 25 aa, Homo sapiens
GTAATTTCACTCAGAAAAAGCCGAT

SEQ ID NO: 1194 - protein, 25 aa, Homo sapiens
TCACTCAGAAAAAGCCGATTTAAGA

SEQ ID NO: 1195 - protein, 25 aa, Homo sapiens
GTGGGATTCCTATAGGTGTCTTTAG

SEQ ID NO: 1196 - protein, 25 aa, Homo sapiens
CAGTGGGATTCCTATAGGTGTCTTT

SEQ ID NO: 1197 - protein, 25 aa, Homo sapiens
TCACAGTGGGATTCCTATAGGTGTC

SEQ ID NO: 1198 - protein, 25 aa, Homo sapiens
CACAGTGGGATTCCTATAGGTGTCT

SEQ ID NO: 1199 - protein, 25 aa, Homo sapiens
GAGTGAGTCACTTACAGCGTCCGGT

SEQ ID NO: 1200 - protein, 25 aa, Homo sapiens
TGGGACTAATAACCCTACGTAGACG

SEQ ID NO: 1201 - protein, 25 aa, Homo sapiens
CGAGAACGACGATTAACGGGTAAGC

SEQ ID NO: 1202 - protein, 25 aa, Homo sapiens
GGACGAGTACTCCAGCGTGGAAAAC

SEQ ID NO: 1203 - protein, 25 aa, Homo sapiens
GTCGGTTCTTCTTGAAGACCCAAGT

SEQ ID NO: 1204 - protein, 25 aa, Homo sapiens
TCGGTTCTTCTTGAAGACCCAAGTC

SEQ ID NO: 1205 - protein, 25 aa, Homo sapiens
CCGACCTACAGGGTGTTGTGATATT

SEQ ID NO: 1206 - protein, 25 aa, Homo sapiens
CAGTTCGGGAAACACAATTCGTTCT

SEQ ID NO: 1207 - protein, 25 aa, Homo sapiens
TGAGGTAGAAAAGTGGGTTTAGTAC

SEQ ID NO: 1208 - protein, 25 aa, Homo sapiens
ACGAGGAAGAGAAGTACGGACACCG

SEQ ID NO: 1209 - protein, 25 aa, Homo sapiens
ACACCGGTTCACTCTAGTCGGGAGT

SEQ ID NO: 1210 - protein, 25 aa, Homo sapiens
TCGTCGGGTACATCTGTCGAAGCCT

SEQ ID NO: 1211 - protein, 25 aa, Homo sapiens
CAAGCCCCATCGAGGAGTAATTGAT

SEQ ID NO: 1212 - protein, 25 aa, Homo sapiens
GATCTCGTATTTGGGTACACACCGG

SEQ ID NO: 1213 - protein, 25 aa, Homo sapiens
AAGAAATTCTGCGTAGTATTTACCA

SEQ ID NO: 1214 - protein, 25 aa, Homo sapiens
ACGAAAGAAATTCTGCGTAGTATTT

SEQ ID NO: 1215 - protein, 25 aa, Homo sapiens
GAAAGAAATTCTGCGTAGTATTTAC

SEQ ID NO: 1216 - protein, 25 aa, Homo sapiens
GAAATTCTGCGTAGTATTTACCAAA

SEQ ID NO: 1217 - protein, 25 aa, Homo sapiens
TCTGAAAACAAGAGCCGCGAGGAGT

SEQ ID NO: 1218 - protein, 25 aa, Homo sapiens
AGGAGTGCTACCTCAAAGTACGAAG

SEQ ID NO: 1219 - protein, 25 aa, Homo sapiens
GTGTTAATCTAACCCTCGAGGAACT

SEQ ID NO: 1220 - protein, 25 aa, Homo sapiens
ACGGAGTGAAGCTCGTCTGAAAACA

SEQ ID NO: 1221 - protein, 25 aa, Homo sapiens
TATTTTGGTATAAACTGACGTGGAA

SEQ ID NO: 1222 - protein, 25 aa, Homo sapiens
ATACTTGGTGTGACTTTGCTGGAAG

SEQ ID NO: 1223 - protein, 25 aa, Homo sapiens
ATACTTGGTGTGACTTTGCTGGAAG

SEQ ID NO: 1224 - protein, 25 aa, Homo sapiens
TCAACTACCGTTGCTACCAATGAGT

SEQ ID NO: 1225 - protein, 25 aa, Homo sapiens
GGGACCCAAGAGTCATCCTTACGAC

SEQ ID NO: 1226 - protein, 25 aa, Homo sapiens
CTCTTTGATGGTTCTGAGGAGGACG

SEQ ID NO: 1227 - protein, 25 aa, Homo sapiens
AGTCTCCCTATATTCTCGGTCGTAG

SEQ ID NO: 1228 - protein, 25 aa, Homo sapiens
ACGACCACGACAGATTTCTGGACCG

SEQ ID NO: 1229 - protein, 25 aa, Homo sapiens
CTGGTCGAAGTTCAGAGGTACCATG

SEQ ID NO: 1230 - protein, 25 aa, Homo sapiens
TCTGGTCGAAGTTCAGAGGTACCAT

SEQ ID NO: 1231 - protein, 25 aa, Homo sapiens
TGGTCGAAGTTCAGAGGTACCATGG

SEQ ID NO: 1232 - protein, 25 aa, Homo sapiens
GGTCGAAGTTCAGAGGTACCATGGT

SEQ ID NO: 1233 - protein, 25 aa, Homo sapiens
ATTCGAATAGAGTCGATTGAGGAGC

SEQ ID NO: 1234 - protein, 25 aa, Homo sapiens
CCTATTATTCGAATAGAGTCGATTG

SEQ ID NO: 1235 - protein, 25 aa, Homo sapiens
ATTATTCGAATAGAGTCGATTGAGG

SEQ ID NO: 1236 - protein, 25 aa, Homo sapiens
TTCCTATTATTCGAATAGAGTCGAT

SEQ ID NO: 1237 - protein, 25 aa, Homo sapiens
TTGGTGGTCTCTTCGGTCATTCTTG

SEQ ID NO: 1238 - protein, 25 aa, Homo sapiens
AACATGAAGGGGGTGGAATTACTGT

SEQ ID NO: 1239 - protein, 25 aa, Homo sapiens
TCGGTCATTCTTGAGGACTCCGGTT

SEQ ID NO: 1240 - protein, 25 aa, Homo sapiens
CTTTTGTAGGTGTTAGTCTTGGGAC

SEQ ID NO: 1241 - protein, 25 aa, Homo sapiens
ATGGAAGGTCGGGATGTCGGAGACC

SEQ ID NO: 1242 - protein, 25 aa, Homo sapiens
GTCGGGATCCCGGAGGAACCCCTGA

SEQ ID NO: 1243 - protein, 25 aa, Homo sapiens
CCTGGAGGGATCTCCAGAGAGGATT

SEQ ID NO: 1244 - protein, 25 aa, Homo sapiens
ACCCTGACGTTCAGGATCCTGGAGG

SEQ ID NO: 1245 - protein, 25 aa, Homo sapiens
TCTCTCGGAGATAGGTCTCCTGGAG

SEQ ID NO: 1246 - protein, 25 aa, Homo sapiens
CTTCTCTCGGAGATAGGTCTCCTGG

SEQ ID NO: 1247 - protein, 25 aa, Homo sapiens
TTCTCTCGGAGATAGGTCTCCTGGA

SEQ ID NO: 1248 - protein, 25 aa, Homo sapiens
TGAGGTAGTGGTCCGCCTCGGGACT

SEQ ID NO: 1249 - protein, 25 aa, Homo sapiens
AGAGGATGGTGACTTTCCCGGTTCA

SEQ ID NO: 1250 - protein, 25 aa, Homo sapiens
GGTCGAGGTGTTGAGGTAGTGGTCC

SEQ ID NO: 1251 - protein, 25 aa, Homo sapiens
GATGGTGACTTTCCCGGTTCAGGGT

SEQ ID NO: 1252 - protein, 25 aa, Homo sapiens
CAGAGGTCAGGAGAATGGAGTGGAT

SEQ ID NO: 1253 - protein, 25 aa, Homo sapiens
TGTCGATGTCAGAGGTCAGGAGAAT

SEQ ID NO: 1254 - protein, 25 aa, Homo sapiens
CTTGTCGATGTCAGAGGTCAGGAGA

SEQ ID NO: 1255 - protein, 25 aa, Homo sapiens
AAGCTTGTCGATGTCAGAGGTCAGG

SEQ ID NO: 1256 - protein, 25 aa, Homo sapiens
GTCGTCCGCGAGAAATCAGTAAAGA

SEQ ID NO: 1257 - protein, 25 aa, Homo sapiens
TCCGCGAGAAATCAGTAAAGAGGGG

SEQ ID NO: 1258 - protein, 25 aa, Homo sapiens
CGTCCGCGAGAAATCAGTAAAGAGG

SEQ ID NO: 1259 - protein, 25 aa, Homo sapiens
CGCGAGAAATCAGTAAAGAGGGGGT

SEQ ID NO: 1260 - protein, 25 aa, Homo sapiens
GTAAAGGTTGAACTCCCTACAGAAG

SEQ ID NO: 1261 - protein, 25 aa, Homo sapiens
TAACCGACGATACACTGGTAGAAGG

SEQ ID NO: 1262 - protein, 25 aa, Homo sapiens
TGAACTCCCTACAGAAGATGTCCCT

SEQ ID NO: 1263 - protein, 25 aa, Homo sapiens
AGCATAACCGACGATACACTGGTAG

SEQ ID NO: 1264 - protein, 25 aa, Homo sapiens
TAAATCCTCGGAACCACCGACCAAA

SEQ ID NO: 1265 - protein, 25 aa, Homo sapiens
ACGGAATGAGCATACACAAACACCA

SEQ ID NO: 1266 - protein, 25 aa, Homo sapiens
TACCGAAAGTAAATCCTCGGAACCA

SEQ ID NO: 1267 - protein, 25 aa, Homo sapiens
GAAAGGGTACGGAATGAGCATACAC

SEQ ID NO: 1268 - protein, 25 aa, Homo sapiens
CTTCTCAAGTTGTTTCGGGTCTGAC

SEQ ID NO: 1269 - protein, 25 aa, Homo sapiens
TCTTGATGATCTCCTCGACGGATAA

SEQ ID NO: 1270 - protein, 25 aa, Homo sapiens
CTTCTAGACTTGGTTCTTGATGATC

SEQ ID NO: 1271 - protein, 25 aa, Homo sapiens
TCCTCGACGGATAAGAAATATTATC

SEQ ID NO: 1272 - protein, 25 aa, Homo sapiens
AGCCTTTGAGCACCTGATACTGTCA

SEQ ID NO: 1273 - protein, 25 aa, Homo sapiens
CCAGCCTTTGAGCACCTGATACTGT

SEQ ID NO: 1274 - protein, 25 aa, Homo sapiens
CCCAGCCTTTGAGCACCTGATACTG

SEQ ID NO: 1275 - protein, 25 aa, Homo sapiens
GCCCCAGCCTTTGAGCACCTGATAC

SEQ ID NO: 1276 - protein, 25 aa, Homo sapiens
TACAACGGGTCAAGTCACTTTAATT

SEQ ID NO: 1277 - protein, 25 aa, Homo sapiens
ATACAACGGGTCAAGTCACTTTAAT

SEQ ID NO: 1278 - protein, 25 aa, Homo sapiens
ACAACGGGTCAAGTCACTTTAATTC

SEQ ID NO: 1279 - protein, 25 aa, Homo sapiens
TTCACCTCGGAAGTGGTCGGAGACT

SEQ ID NO: 1280 - protein, 25 aa, Homo sapiens
GTGTGACACGTAAACACATCGGAGT

SEQ ID NO: 1281 - protein, 25 aa, Homo sapiens
CACCTAGGGAGATTAAAACTGGGAG

SEQ ID NO: 1282 - protein, 25 aa, Homo sapiens
CTGGAACACGGGACAAGAATTAGAG

SEQ ID NO: 1283 - protein, 25 aa, Homo sapiens
GTCGCTCACCCTGCCAGTACTCCTC

SEQ ID NO: 1284 - protein, 25 aa, Homo sapiens
TGTCGTCGCTCACCCTGCCAGTACT

SEQ ID NO: 1285 - protein, 25 aa, Homo sapiens
ACGTACTTTCAAGTTTTTCTCACAG

SEQ ID NO: 1286 - protein, 25 aa, Homo sapiens
TAGATGTCGTCGCTCACCCTGCCAG

SEQ ID NO: 1287 - protein, 25 aa, Homo sapiens
ACTTCTTGAAGGAATCACGTCAGTT

SEQ ID NO: 1288 - protein, 25 aa, Homo sapiens
TTCTTGAAGGAATCACGTCAGTTTC

SEQ ID NO: 1289 - protein, 25 aa, Homo sapiens
CTTCCGGTGTTCGACATGTTCCTGG

SEQ ID NO: 1290 - protein, 25 aa, Homo sapiens
GGTGTTCGACATGTTCCTGGACTTC

SEQ ID NO: 1291 - protein, 25 aa, Homo sapiens
CTTGCTAAACTTGTTTCGCGATCGT

SEQ ID NO: 1292 - protein, 25 aa, Homo sapiens
CTAAACTTGTTTCGCGATCGTTGAA

SEQ ID NO: 1293 - protein, 25 aa, Homo sapiens
TGCTAAACTTGTTTCGCGATCGTTG

SEQ ID NO: 1294 - protein, 25 aa, Homo sapiens
ACTTGCTAAACTTGTTTCGCGATCG

SEQ ID NO: 1295 - protein, 25 aa, Homo sapiens
GGATACCCTTCCAGATCGAGCTTTG

SEQ ID NO: 1296 - protein, 25 aa, Homo sapiens
GCACATCGGTCTGAAGCAATGAAGT

SEQ ID NO: 1297 - protein, 25 aa, Homo sapiens
CTCGTGACGAAACTCGGGACCCTTC

SEQ ID NO: 1298 - protein, 25 aa, Homo sapiens
GGTCGAGAGGGCTCAACTAAATAGT

SEQ ID NO: 1299 - protein, 25 aa, Homo sapiens
ACGTCTTCTTCAAATCGTCCCGGGT

SEQ ID NO: 1300 - protein, 25 aa, Homo sapiens
GCCGCGCCGGCCGGAGAAGCGGTTC

SEQ ID NO: 1301 - protein, 25 aa, Homo sapiens
TCTTCTTCAAATCGTCCCGGGTCCT

SEQ ID NO: 1302 - protein, 25 aa, Homo sapiens
CACGTCTTCTTCAAATCGTCCCGGG

SEQ ID NO: 1303 - protein, 25 aa, Homo sapiens
CGGCCCTCGGGCGTGAAGGAGGAGC

SEQ ID NO: 1304 - protein, 25 aa, Homo sapiens
TCTTTTGGTGTCCCGCGCCCCGGTC

SEQ ID NO: 1305 - protein, 25 aa, Homo sapiens
AGTCTTTTGGTGTCCCGCGCCCCGG

SEQ ID NO: 1306 - protein, 25 aa, Homo sapiens
GCCCTCGGGCGTGAAGGAGGAGCCC

SEQ ID NO: 1307 - protein, 25 aa, Homo sapiens
CCGAATCTCGGATGGACCTCGTTCT

SEQ ID NO: 1308 - protein, 25 aa, Homo sapiens
AGGGATGGTCAAGGTCCGAATCTCG

SEQ ID NO: 1309 - protein, 25 aa, Homo sapiens
GAGTCTCTTGGATTTGCACAAAAGC

SEQ ID NO: 1310 - protein, 25 aa, Homo sapiens
TGCGTCACATGTACCGCCGAAGCGT

SEQ ID NO: 1311 - protein, 25 aa, Homo sapiens
ATCTCCGGCTCAGAAGCCGGTGGGT

SEQ ID NO: 1312 - protein, 25 aa, Homo sapiens
GCCTCATTCTTTGGTCTTCGCCTAG

SEQ ID NO: 1313 - protein, 25 aa, Homo sapiens
GTGGAGTGTCTTCCTGCTTGGTCAC

SEQ ID NO: 1314 - protein, 25 aa, Homo sapiens
AGCCGGTGGGTTTCCGCCTCATTCT

SEQ ID NO: 1315 - protein, 25 aa, Homo sapiens
ACCAGAGCTGCACCCCGCCGGTCGC

SEQ ID NO: 1316 - protein, 25 aa, Homo sapiens
CGCCGTGACCAGAGCTGCACCCCGC

SEQ ID NO: 1317 - protein, 25 aa, Homo sapiens
GTGACCAGAGCTGCACCCCGCCGGT

SEQ ID NO: 1318 - protein, 25 aa, Homo sapiens
CCTCCGCCGTGACCAGAGCTGCACC

SEQ ID NO: 1319 - protein, 25 aa, Homo sapiens
AACATTTAAATTTCTACAATCTTCT

SEQ ID NO: 1320 - protein, 25 aa, Homo sapiens
ACATTTAAATTTCTACAATCTTCTT

SEQ ID NO: 1321 - protein, 25 aa, Homo sapiens
TGTTCTGTATAAACAAAAGACGTGG

SEQ ID NO: 1322 - protein, 25 aa, Homo sapiens
ACACCATATGTTCTGTATAAACAAA

SEQ ID NO: 1323 - protein, 25 aa, Homo sapiens
TTCTGTATAAACAAAAGACGTGGTC

SEQ ID NO: 1324 - protein, 25 aa, Homo sapiens
ACCATATGTTCTGTATAAACAAAAG

SEQ ID NO: 1325 - protein, 25 aa, Homo sapiens
AGGGTTTGGAAGACCTAGAGATGGT

SEQ ID NO: 1326 - protein, 25 aa, Homo sapiens
GGGTTTGGAAGACCTAGAGATGGTC

SEQ ID NO: 1327 - protein, 25 aa, Homo sapiens
TGGGTAGTAGTAGGTTAGCGTCTAC

SEQ ID NO: 1328 - protein, 25 aa, Homo sapiens
AGTAGTAGGTTAGCGTCTACCTCCC

SEQ ID NO: 1329 - protein, 25 aa, Homo sapiens
GTTACACCTTAATAGTGGGTAGTAG

SEQ ID NO: 1330 - protein, 25 aa, Homo sapiens
TAATAGTGGGTAGTAGTAGGTTAGC

SEQ ID NO: 1331 - protein, 25 aa, Homo sapiens
CTTTATTACCTTCTCGAATGTTGGA

SEQ ID NO: 1332 - protein, 25 aa, Homo sapiens
AGTGGTCTCGTTCGGTATCTGTCGG

SEQ ID NO: 1333 - protein, 25 aa, Homo sapiens
CCTAGGCCCCGTTATGTCTGGTAGT

SEQ ID NO: 1334 - protein, 25 aa, Homo sapiens
GTCGGACGCTCTGGATTCTCCTAGG

SEQ ID NO: 1335 - protein, 25 aa, Homo sapiens
GACAGACTGTGTTATAGTGGTCTCG

SEQ ID NO: 1336 - protein, 25 aa, Homo sapiens
GGTCAGGCAAAACCCTTACCTAGGA

SEQ ID NO: 1337 - protein, 25 aa, Homo sapiens
TGAAGAGTCAAAAACGGGGTCAGGC

SEQ ID NO: 1338 - protein, 25 aa, Homo sapiens
CAGGCAAAACCCTTACCTAGGAGAG

SEQ ID NO: 1339 - protein, 25 aa, Homo sapiens
GCAAAACCCTTACCTAGGAGAGTGG

SEQ ID NO: 1340 - protein, 25 aa, Homo sapiens
TTACTCTACCAATAACAATTATGTT

SEQ ID NO: 1341 - protein, 25 aa, Homo sapiens
GTTACTCTACCAATAACAATTATGT

SEQ ID NO: 1342 - protein, 25 aa, Homo sapiens
CTGTTACTCTACCAATAACAATTAT

SEQ ID NO: 1343 - protein, 25 aa, Homo sapiens
TGTTACTCTACCAATAACAATTATG

SEQ ID NO: 1344 - protein, 25 aa, Homo sapiens
TATGTTAATAGAAGTACTCAAAGCC

SEQ ID NO: 1345 - protein, 25 aa, Homo sapiens
TGTTAATAGAAGTACTCAAAGCCCT

SEQ ID NO: 1346 - protein, 25 aa, Homo sapiens
GTTATGTTAATAGAAGTACTCAAAG

SEQ ID NO: 1347 - protein, 25 aa, Homo sapiens
GTTAATAGAAGTACTCAAAGCCCTG

SEQ ID NO: 1348 - protein, 25 aa, Homo sapiens
AAGTGTTAGTTCTAGACATAGTTCT

SEQ ID NO: 1349 - protein, 25 aa, Homo sapiens
TGTTAGTTCTAGACATAGTTCTATT

SEQ ID NO: 1350 - protein, 25 aa, Homo sapiens
GTGTTAGTTCTAGACATAGTTCTAT

SEQ ID NO: 1351 - protein, 25 aa, Homo sapiens
TAAGTGTTAGTTCTAGACATAGTTC

SEQ ID NO: 1352 - protein, 25 aa, Homo sapiens
ACGTCTATAAGGATTTCAAAATAAC

SEQ ID NO: 1353 - protein, 25 aa, Homo sapiens
TTACTTTGGTGGTCACAATAGTTGA

SEQ ID NO: 1354 - protein, 25 aa, Homo sapiens
TTACATGTACACGTCTATAAGGATT

SEQ ID NO: 1355 - protein, 25 aa, Homo sapiens
CTTTACAGTCAAGAGATCGTATTAA

SEQ ID NO: 1356 - protein, 25 aa, Homo sapiens
GGCGCGGAATCGGCGCTTCAAGATC

SEQ ID NO: 1357 - protein, 25 aa, Homo sapiens
ACCGGGCAAACTTTACGCGGTCCGC

SEQ ID NO: 1358 - protein, 25 aa, Homo sapiens
CCGAAGCGTCTCGTGGCGCGGAATC

SEQ ID NO: 1359 - protein, 25 aa, Homo sapiens
CCCGAGAATCGCAGCGGCGGCCGAA

SEQ ID NO: 1360 - protein, 25 aa, Homo sapiens
AGGGCGTACGCGCAAACCCGCCGCA

SEQ ID NO: 1361 - protein, 25 aa, Homo sapiens
GTCGGCAGGGCGTACGCGCAAACCC

SEQ ID NO: 1362 - protein, 25 aa, Homo sapiens
GCGTCAGAAGCGGTCGGTCGGCAGG

SEQ ID NO: 1363 - protein, 25 aa, Homo sapiens
AAGAACGACGGCCAGGATTGCAGGG

SEQ ID NO: 1364 - protein, 25 aa, Homo sapiens
CCCGATGTCTGAGTTGGCTTTACCT

SEQ ID NO: 1365 - protein, 25 aa, Homo sapiens
CCCGAAAGGACTAGTTCTCACAACG

SEQ ID NO: 1366 - protein, 25 aa, Homo sapiens
GTCGAAGTATGAGGACTCCCGATGT

SEQ ID NO: 1367 - protein, 25 aa, Homo sapiens
ATCCCACGCGGGTGACCCGAAAGGA

SEQ ID NO: 1368 - protein, 25 aa, Homo sapiens
TGGTGGGTCTTCCTTGAGAAACTAC

SEQ ID NO: 1369 - protein, 25 aa, Homo sapiens
TTCATAAACCGTGAGTGTGGTGGGT

SEQ ID NO: 1370 - protein, 25 aa, Homo sapiens
TTACTGGAGTAAGTACCGTTTTTAC

SEQ ID NO: 1371 - protein, 25 aa, Homo sapiens
CTACAACACCGATTAGGGAACCAGT

SEQ ID NO: 1372 - protein, 25 aa, Homo sapiens
GAGTGTGTTACTGACCAAGAGGTCC

SEQ ID NO: 1373 - protein, 25 aa, Homo sapiens
GGAGCAACAAACCTGTACTAGAAAT

SEQ ID NO: 1374 - protein, 25 aa, Homo sapiens
GTATACCACACTGCCCTTCACCTTT

SEQ ID NO: 1375 - protein, 25 aa, Homo sapiens
ATCCCAGTAAAGTTCGATTTGCTAT

SEQ ID NO: 1376 - protein, 25 aa, Homo sapiens
TTTCTCTTCGATACGGGTTAGGTTT

SEQ ID NO: 1377 - protein, 25 aa, Homo sapiens
TATATGTCACACTCCAACTACGGAA

SEQ ID NO: 1378 - protein, 25 aa, Homo sapiens
CTACGGAATAATCTTGCAGTCTTTT

SEQ ID NO: 1379 - protein, 25 aa, Homo sapiens
CAAAAGTTTAGATTACTATCCTTAT

SEQ ID NO: 1380 - protein, 25 aa, Homo sapiens
TTTTACCTGAATATTGCATATGTTA

SEQ ID NO: 1381 - protein, 25 aa, Homo sapiens
AATTTTACCTGAATATTGCATATGT

SEQ ID NO: 1382 - protein, 25 aa, Homo sapiens
CTGAATATTGCATATGTTAACTTGA

SEQ ID NO: 1383 - protein, 25 aa, Homo sapiens
ACCTGAATATTGCATATGTTAACTT

SEQ ID NO: 1384 - protein, 25 aa, Homo sapiens
ATACTATTGACATGTTCTTAAGACG

SEQ ID NO: 1385 - protein, 25 aa, Homo sapiens
CTTCTCCACGGCAAACTAGGGTATT

SEQ ID NO: 1386 - protein, 25 aa, Homo sapiens
TCTATCACAGATACCACATAAACAG

SEQ ID NO: 1387 - protein, 25 aa, Homo sapiens
TGCTGTTCATCTAGGTCTCAAACGT

SEQ ID NO: 1388 - protein, 25 aa, Homo sapiens
CAGTGAACCGCAAAATCAGGATCAG

SEQ ID NO: 1389 - protein, 25 aa, Homo sapiens
ATAAAGAGACCTCATAATATGCAAT

SEQ ID NO: 1390 - protein, 25 aa, Homo sapiens
CTATGGTCGTAGAGTATTAAATCCT

SEQ ID NO: 1391 - protein, 25 aa, Homo sapiens
TCAGGATCAGAATTTACTTCTATGG

SEQ ID NO: 1392 - protein, 25 aa, Homo sapiens
TACAACGTCCTACATGTCTTCAACT

SEQ ID NO: 1393 - protein, 25 aa, Homo sapiens
GGAGGTGTTAGATTTAACGAAGCAC

SEQ ID NO: 1394 - protein, 25 aa, Homo sapiens
AACGAAGCACTTCTATTCTTGGTAT

SEQ ID NO: 1395 - protein, 25 aa, Homo sapiens
AACTTCACTTTAGATGACTCCTCCG

SEQ ID NO: 1396 - protein, 25 aa, Homo sapiens
AAACTGAATAATCTTTCGTACATAT

SEQ ID NO: 1397 - protein, 25 aa, Homo sapiens
AGTGGATCTCAACGATGATTCAAAC

SEQ ID NO: 1398 - protein, 25 aa, Homo sapiens
CGATGATTCAAACTACCGTTAAAAA

SEQ ID NO: 1399 - protein, 25 aa, Homo sapiens
ACTACTTATAGTGGATCTCAACGAT

SEQ ID NO: 1400 - protein, 25 aa, Homo sapiens
TAATTTAATCAAGTCCGAGGGAACC

SEQ ID NO: 1401 - protein, 25 aa, Homo sapiens
TGGGTAAACTTAGCACTCAGGTCGG

SEQ ID NO: 1402 - protein, 25 aa, Homo sapiens
CTCTGCATAACGATTATGGGTAAAC

SEQ ID NO: 1403 - protein, 25 aa, Homo sapiens
GCAAGGGTATCGCACAAGTTGTAAT

SEQ ID NO: 1404 - protein, 25 aa, Homo sapiens
GTCTTCCCTTGTCTAATGCACTTCG

SEQ ID NO: 1405 - protein, 25 aa, Homo sapiens
CACTTTCTTGATTGGCCTGGTCTCG

SEQ ID NO: 1406 - protein, 25 aa, Homo sapiens
GAACCATCTAGAACGACCTTCACTT

SEQ ID NO: 1407 - protein, 25 aa, Homo sapiens
TCTTGTTTAGTGATATTCAGTCAAC

SEQ ID NO: 1408 - protein, 25 aa, Homo sapiens
GTTTCAATTGGGTAGACAAGTTCTT

SEQ ID NO: 1409 - protein, 25 aa, Homo sapiens
ACGCCTACTAGCACACACACTTGGG

SEQ ID NO: 1410 - protein, 25 aa, Homo sapiens
CCAAGGTATAGCTCTAAGTTTCAAT

SEQ ID NO: 1411 - protein, 25 aa, Homo sapiens
AGTTCTTGATGAAACTACCCCTTCC

SEQ ID NO: 1412 - protein, 25 aa, Homo sapiens
TGGTAACCAATGACTGCACCAAAAC

SEQ ID NO: 1413 - protein, 25 aa, Homo sapiens
GTAACCAATGACTGCACCAAAACGT

SEQ ID NO: 1414 - protein, 25 aa, Homo sapiens
GGTAACCAATGACTGCACCAAAACG

SEQ ID NO: 1415 - protein, 25 aa, Homo sapiens
TAACCAATGACTGCACCAAAACGTC

SEQ ID NO: 1416 - protein, 25 aa, Homo sapiens
CTATAGTTGCTACTCGTCTGTGAAG

SEQ ID NO: 1417 - protein, 25 aa, Homo sapiens
TCTGTGAAGGTTCCGACTAACTTCG

SEQ ID NO: 1418 - protein, 25 aa, Homo sapiens
TAACTTCGGAATCTCTTTGCTGTAT

SEQ ID NO: 1419 - protein, 25 aa, Homo sapiens
GGAAACGGTAGTACGCTTTAAAACC

SEQ ID NO: 1420 - protein, 25 aa, Homo sapiens
TTACGAAAATTTCGAAACAATGTTC

SEQ ID NO: 1421 - protein, 25 aa, Homo sapiens
GATTACGAAAATTTCGAAACAATGT

SEQ ID NO: 1422 - protein, 25 aa, Homo sapiens
ATTACGAAAATTTCGAAACAATGTT

SEQ ID NO: 1423 - protein, 25 aa, Homo sapiens
TTCTTTTGGTGTACGTTCCCTTTGA

SEQ ID NO: 1424 - protein, 25 aa, Homo sapiens
TCTATTTGCGTTAAACGTTGTCCTT

SEQ ID NO: 1425 - protein, 25 aa, Homo sapiens
TGTTGATGATAGATACTCCTTCTAT

SEQ ID NO: 1426 - protein, 25 aa, Homo sapiens
ACCACTGTCTTTGCTGTTACTTCAC

SEQ ID NO: 1427 - protein, 25 aa, Homo sapiens
ACTGTTTGCGTCTAATCTTCGGTCC

SEQ ID NO: 1428 - protein, 25 aa, Homo sapiens
CATCTCACCGTCGGTTTGTCGACCT

SEQ ID NO: 1429 - protein, 25 aa, Homo sapiens
TCGCATCTCACCGTCGGTTTGTCGA

SEQ ID NO: 1430 - protein, 25 aa, Homo sapiens
CGACCTCTACGTCTTATTTGAGACC

SEQ ID NO: 1431 - protein, 25 aa, Homo sapiens
CTCACCGTCGGTTTGTCGACCTCTA

SEQ ID NO: 1432 - protein, 25 aa, Homo sapiens
GTCTCTCTGGGAGAGCCCTCGCTCT

SEQ ID NO: 1433 - protein, 25 aa, Homo sapiens
CTCGCTCTAGCTCTTTTTCAATGAG

SEQ ID NO: 1434 - protein, 25 aa, Homo sapiens
TTCGACTTTGTTGACTTCCGATAAC

SEQ ID NO: 1435 - protein, 25 aa, Homo sapiens
GACTTCCGATAACAATGGCTTGGAT

SEQ ID NO: 1436 - protein, 25 aa, Homo sapiens
CCCTCCACCAAGGATGTAAGTCTTT

SEQ ID NO: 1437 - protein, 25 aa, Homo sapiens
GTAGATAACGTTCCGCATCCGTCGT

SEQ ID NO: 1438 - protein, 25 aa, Homo sapiens
GTCGGTGTCGATGTATCCGCGAGAT

SEQ ID NO: 1439 - protein, 25 aa, Homo sapiens
TCCGCGAGATTGAGAACGTCGTCGT

SEQ ID NO: 1440 - protein, 25 aa, Homo sapiens
AGACAAAACAAATCTTCGGATCTTT

SEQ ID NO: 1441 - protein, 25 aa, Homo sapiens
GGAGAGTTATCGTCCCTATTTATAA

SEQ ID NO: 1442 - protein, 25 aa, Homo sapiens
AACACCTGTATTATCTAATGGAGAG

SEQ ID NO: 1443 - protein, 25 aa, Homo sapiens
TCCTTTCTGAACGTCGTAATGGTCT

SEQ ID NO: 1444 - protein, 25 aa, Homo sapiens
ATTTAATTAAGACCCAATACGAACA

SEQ ID NO: 1445 - protein, 25 aa, Homo sapiens
TTAATTAAGACCCAATACGAACAAA

SEQ ID NO: 1446 - protein, 25 aa, Homo sapiens
AATTAAGACCCAATACGAACAAAGA

SEQ ID NO: 1447 - protein, 25 aa, Homo sapiens
TAATTAAGACCCAATACGAACAAAG

SEQ ID NO: 1448 - protein, 25 aa, Homo sapiens
CGGAGGCTACCCCTCTAACTTTGAT

SEQ ID NO: 1449 - protein, 25 aa, Homo sapiens
TCTGCTAGTGCGAGACGTCCTCTGT

SEQ ID NO: 1450 - protein, 25 aa, Homo sapiens
ACCCATCTAGTATTCGGGCGGAGAT

SEQ ID NO: 1451 - protein, 25 aa, Homo sapiens
GGAGTACGGTAGTGTCATAGACAAC

SEQ ID NO: 1452 - protein, 25 aa, Homo sapiens
GTTCCCCACCACCTGTTAGACAAGT

SEQ ID NO: 1453 - protein, 25 aa, Homo sapiens
TTTTGTTCCCCACCACCTGTTAGAC

SEQ ID NO: 1454 - protein, 25 aa, Homo sapiens
CAAATGACTATAACTCTGAAATTTC

SEQ ID NO: 1455 - protein, 25 aa, Homo sapiens
CCCACCACCTGTTAGACAAGTCAAA

SEQ ID NO: 1456 - protein, 25 aa, Homo sapiens
CTTTTTAATTTATAAACAGACGGAT

SEQ ID NO: 1457 - protein, 25 aa, Homo sapiens
ATGGACCTACTGGATTTCTGGAAAG

SEQ ID NO: 1458 - protein, 25 aa, Homo sapiens
CTGGAAAGACCGAGTGTTGTAAACA

SEQ ID NO: 1459 - protein, 25 aa, Homo sapiens
GATAACTCTCCTCGACTAGAAAAAG

SEQ ID NO: 1460 - protein, 25 aa, Homo sapiens
TGGATCCACACCTCGGACGATTTAT

SEQ ID NO: 1461 - protein, 25 aa, Homo sapiens
ACCTATAGTCGTAGTGCGTGTTGGG

SEQ ID NO: 1462 - protein, 25 aa, Homo sapiens
CTATAGTCGTAGTGCGTGTTGGGTT

SEQ ID NO: 1463 - protein, 25 aa, Homo sapiens
CCTATAGTCGTAGTGCGTGTTGGGT

SEQ ID NO: 1464 - protein, 25 aa, Homo sapiens
AACTTTTAGTGCCTGGAGTCGATGT

SEQ ID NO: 1465 - protein, 25 aa, Homo sapiens
TACCAAGGTTTCTGTTGATCATAAG

SEQ ID NO: 1466 - protein, 25 aa, Homo sapiens
GAGCTTTCGGTACGGTCTTCGTCAG

SEQ ID NO: 1467 - protein, 25 aa, Homo sapiens
TCTCGTTTCGAAAGGGATACCAAGG

SEQ ID NO: 1468 - protein, 25 aa, Homo sapiens
TGTAAATCTATACGGTTTTCTTAAT

SEQ ID NO: 1469 - protein, 25 aa, Homo sapiens
AAATCTATACGGTTTTCTTAATTTT

SEQ ID NO: 1470 - protein, 25 aa, Homo sapiens
ACTGTAAATCTATACGGTTTTCTTA

SEQ ID NO: 1471 - protein, 25 aa, Homo sapiens
AGACTGTAAATCTATACGGTTTTCT

SEQ ID NO: 1472 - protein, 25 aa, Homo sapiens
CTCCTCAACGGTTGTAAACGGAAAG

SEQ ID NO: 1473 - protein, 25 aa, Homo sapiens
CATCACCAACTGTAGAGTCTAACAC

SEQ ID NO: 1474 - protein, 25 aa, Homo sapiens
TCAATAAAAGTGGTGGACAGGGTCT

SEQ ID NO: 1475 - protein, 25 aa, Homo sapiens
GTCGGTCAGTCCAACGATTCGTCAC

SEQ ID NO: 1476 - protein, 25 aa, Homo sapiens
AGGTACTATGGGGTCTCTCCTCACG

SEQ ID NO: 1477 - protein, 25 aa, Homo sapiens
ACGTCGTCTATTGTTCCTGGACTAG

SEQ ID NO: 1478 - protein, 25 aa, Homo sapiens
GACTAGAATCTAGGTACGACAGTCG

SEQ ID NO: 1479 - protein, 25 aa, Homo sapiens
TCGGGAAAGGTTTCTAGGGACTTCA

SEQ ID NO: 1480 - protein, 25 aa, Homo sapiens
TACGTCGTGACCAATGGTCCTACTT

SEQ ID NO: 1481 - protein, 25 aa, Homo sapiens
TGTTCGTTCCGTCTTCCTTTCGTGG

SEQ ID NO: 1482 - protein, 25 aa, Homo sapiens
TGTGTAGTAACATCACGACCTAGGT

SEQ ID NO: 1483 - protein, 25 aa, Homo sapiens
TCTTTTGGTTCGGCTCAGTCTTCCA

SEQ ID NO: 1484 - protein, 25 aa, Homo sapiens
CGTGACGTCTGGTACCTCACGGCGA

SEQ ID NO: 1485 - protein, 25 aa, Homo sapiens
GGATCCTCGTGACGTCTGGTACCTC

SEQ ID NO: 1486 - protein, 25 aa, Homo sapiens
CCACCCCCGGTCGAGGATCCTCGTG

SEQ ID NO: 1487 - protein, 25 aa, Homo sapiens
TTCCACCCCCGGTCGAGGATCCTCG

SEQ ID NO: 1488 - protein, 25 aa, Homo sapiens
TCCGACACGGAACGTCACAGTGAAC

SEQ ID NO: 1489 - protein, 25 aa, Homo sapiens
ACACGGAACGTCACAGTGAACCTCC

SEQ ID NO: 1490 - protein, 25 aa, Homo sapiens
GCGTCCGACACGGAACGTCACAGTG

SEQ ID NO: 1491 - protein, 25 aa, Homo sapiens
CGACACGGAACGTCACAGTGAACCT

SEQ ID NO: 1492 - protein, 25 aa, Homo sapiens
GTAAACACAGGTACTAGCTGTTACC

SEQ ID NO: 1493 - protein, 25 aa, Homo sapiens
CCTCGGTTGTCATGACCACAACGAG

SEQ ID NO: 1494 - protein, 25 aa, Homo sapiens
TCCGTAAACACAGGTACTAGCTGTT

SEQ ID NO: 1495 - protein, 25 aa, Homo sapiens
GTCATGACCACAACGAGGCCCGTCT

SEQ ID NO: 1496 - protein, 25 aa, Homo sapiens
CCTTCGGACCTGTCGTGATACTTTC

SEQ ID NO: 1497 - protein, 25 aa, Homo sapiens
CTTCCTTTGCGAAGTCCCGAAACAT

SEQ ID NO: 1498 - protein, 25 aa, Homo sapiens
CGTCCCTTTCGAGACAGTGACCACT

SEQ ID NO: 1499 - protein, 25 aa, Homo sapiens
CAGTGAGACGTTCCATCAGGTAGAG

SEQ ID NO: 1500 - protein, 25 aa, Homo sapiens
AAAGTACAATTTTCCCCGTCGAGAA

SEQ ID NO: 1501 - protein, 25 aa, Homo sapiens
CCCTACGAGACCAGGTCAGAAGAAG

SEQ ID NO: 1502 - protein, 25 aa, Homo sapiens
ATAAGTAACGTCTACATCCAGTGAG

SEQ ID NO: 1503 - protein, 25 aa, Homo sapiens
GGACCTCGACGACAAGAAACTAAAG

SEQ ID NO: 1504 - protein, 25 aa, Homo sapiens
AGAAACTAAAGGAGGGGACGTGGTC

SEQ ID NO: 1505 - protein, 25 aa, Homo sapiens
CTCGACGACAAGAAACTAAAGGAGG

SEQ ID NO: 1506 - protein, 25 aa, Homo sapiens
CGACGACAAGAAACTAAAGGAGGGG

SEQ ID NO: 1507 - protein, 25 aa, Homo sapiens
TACCATAGGTCCCATCTGCGACTTC

SEQ ID NO: 1508 - protein, 25 aa, Homo sapiens
TCTCCGGTCGTATCCCAGGTACCAT

SEQ ID NO: 1509 - protein, 25 aa, Homo sapiens
AGGTACCATAGGTCCCATCTGCGAC

SEQ ID NO: 1510 - protein, 25 aa, Homo sapiens
GTATCCCAGGTACCATAGGTCCCAT

SEQ ID NO: 1511 - protein, 25 aa, Homo sapiens
GACCTTTCTCGACCGGCTGAAGTGT

SEQ ID NO: 1512 - protein, 25 aa, Homo sapiens
GACCGGCTGAAGTGTACGCGTAAGT

SEQ ID NO: 1513 - protein, 25 aa, Homo sapiens
CGGGTCCGAGTTTAACACGTCTCGA

SEQ ID NO: 1514 - protein, 25 aa, Homo sapiens
TCCGAGTTTAACACGTCTCGACCTT

SEQ ID NO: 1515 - protein, 25 aa, Homo sapiens
GTCCGACTATAGTATCCGGTCCAAT

SEQ ID NO: 1516 - protein, 25 aa, Homo sapiens
ACTCCGGACTTCTCTAACTGAACAG

SEQ ID NO: 1517 - protein, 25 aa, Homo sapiens
GGTATCCGGTTCAATGGTCCTAATT

SEQ ID NO: 1518 - protein, 25 aa, Homo sapiens
AAAGTCAACGGTGAACTCCCCTTGT

SEQ ID NO: 1519 - protein, 25 aa, Homo sapiens
ACGTCAACACTTACGGATAGGGAGG

SEQ ID NO: 1520 - protein, 25 aa, Homo sapiens
CCTGAGCGTGATCAGACCTCCTCTG

SEQ ID NO: 1521 - protein, 25 aa, Homo sapiens
TAAGTCGTCGACTTGGCTCAGTCGG

SEQ ID NO: 1522 - protein, 25 aa, Homo sapiens
TCGAGGCTCTACTTTGATGGAAGAG

SEQ ID NO: 1523 - protein, 25 aa, Homo sapiens
CTTGCGGTCTTAAACGAGCGTCTGT

SEQ ID NO: 1524 - protein, 25 aa, Homo sapiens
CACTGTAGGTGAAGAGCGGCGTAAC

SEQ ID NO: 1525 - protein, 25 aa, Homo sapiens
CTGGTCTTGATAGGTCCGCATAGAT

SEQ ID NO: 1526 - protein, 25 aa, Homo sapiens
TAGTCGTCACAAAAAGCCTATTTCT

SEQ ID NO: 1527 - protein, 25 aa, Homo sapiens
ACCGTAAATTACAAGGAGAGGACCG

SEQ ID NO: 1528 - protein, 25 aa, Homo sapiens
GGTTCCTTGCCCTAATACTACTGAT

SEQ ID NO: 1529 - protein, 25 aa, Homo sapiens
CTACTGATACGCCTGAAGATATAAC

SEQ ID NO: 1530 - protein, 25 aa, Homo sapiens
CTCCGGGTCAGAAAGAACCCAGAAT

SEQ ID NO: 1531 - protein, 25 aa, Homo sapiens
GCCCCTGTTGTAAACTAGGTTCTAG

SEQ ID NO: 1532 - protein, 25 aa, Homo sapiens
ACGAGTCGTTACTCGATAATCTAAG

SEQ ID NO: 1533 - protein, 25 aa, Homo sapiens
TCTGGACAGATGTAACAATATACAC

SEQ ID NO: 1534 - protein, 25 aa, Homo sapiens
GACCTAACGTCTTCTGAGCCCCTGT

SEQ ID NO: 1535 - protein, 25 aa, Homo sapiens
TCACTGGTAGAGTACCCGTAACAAA

SEQ ID NO: 1536 - protein, 25 aa, Homo sapiens
AAGAGTTTAGTAGTCTCCGGCTTCT

SEQ ID NO: 1537 - protein, 25 aa, Homo sapiens
GACTAGTGAAGTCGCATTTCGTCAC

SEQ ID NO: 1538 - protein, 25 aa, Homo sapiens
TGTGAAACCGACACAGATATTGAAC

SEQ ID NO: 1539 - protein, 25 aa, Homo sapiens
TAGACATGCCCGTTTCTTTGGATAT

SEQ ID NO: 1540 - protein, 25 aa, Homo sapiens
GGTATACCTGAAACTGAGTCGACAC

SEQ ID NO: 1541 - protein, 25 aa, Homo sapiens
CGAGGAGCCCGTTTTAGACATGCCC

SEQ ID NO: 1542 - protein, 25 aa, Homo sapiens
GTTCCCCCTCTCACTACTGAAGGTA

SEQ ID NO: 1543 - protein, 25 aa, Homo sapiens
ACAAAGCTTTCGTCAGTGTTCGTTC

SEQ ID NO: 1544 - protein, 25 aa, Homo sapiens
GACCACAGAGAGTTTTCGGACTAGG

SEQ ID NO: 1545 - protein, 25 aa, Homo sapiens
ACGGTTTTGGTTCTTAGCGGCGTTT

SEQ ID NO: 1546 - protein, 25 aa, Homo sapiens
AGCGGCGTTTTCCTTCGGTAGGTGA

SEQ ID NO: 1547 - protein, 25 aa, Homo sapiens
TCAAGGATTTTTCTTACACTGTCAC

SEQ ID NO: 1548 - protein, 25 aa, Homo sapiens
CAAGGATTTTTCTTACACTGTCACT

SEQ ID NO: 1549 - protein, 25 aa, Homo sapiens
GATTTTTCTTACACTGTCACTTCTT

SEQ ID NO: 1550 - protein, 25 aa, Homo sapiens
AGGATTTTTCTTACACTGTCACTTC

SEQ ID NO: 1551 - protein, 25 aa, Homo sapiens
ACATGGTGACAGAAGTTCGGGAGGA

SEQ ID NO: 1552 - protein, 25 aa, Homo sapiens
CCGTCACATGGTGACAGAAGTTCGG

SEQ ID NO: 1553 - protein, 25 aa, Homo sapiens
TTCGGGAGGACGATGTGTAAAGGGT

SEQ ID NO: 1554 - protein, 25 aa, Homo sapiens
TCGGGAGGACGATGTGTAAAGGGTC

SEQ ID NO: 1555 - protein, 25 aa, Homo sapiens
AATCATTGTTTCTTGACTTTGGTGT

SEQ ID NO: 1556 - protein, 25 aa, Homo sapiens
CTTTGGTGTCTTTTCACAGCACAGT

SEQ ID NO: 1557 - protein, 25 aa, Homo sapiens
TTTGGTGTCTTTTCACAGCACAGTC

SEQ ID NO: 1558 - protein, 25 aa, Homo sapiens
ATCATTGTTTCTTGACTTTGGTGTC

SEQ ID NO: 1559 - protein, 25 aa, Homo sapiens
ACTACTTCTAAAACAGGGTAGTCTA

SEQ ID NO: 1560 - protein, 25 aa, Homo sapiens
TGTTTGATGTAACCGTAAATTCGGT

SEQ ID NO: 1561 - protein, 25 aa, Homo sapiens
TCTCTTTAGGGACCAGACTAAGTCT

SEQ ID NO: 1562 - protein, 25 aa, Homo sapiens
CATTAAAACTACAGGGAGGTGCTCT

SEQ ID NO: 1563 - protein, 25 aa, Homo sapiens
AGTCTATCCTCGTCACTGCTTTCAT

SEQ ID NO: 1564 - protein, 25 aa, Homo sapiens
ACACCTTGATCTTCCGGATTTTGTT

SEQ ID NO: 1565 - protein, 25 aa, Homo sapiens
GATCTTCCGGATTTTGTTTCTAATC

SEQ ID NO: 1566 - protein, 25 aa, Homo sapiens
TCTACCACACCTTGATCTTCCGGAT

SEQ ID NO: 1567 - protein, 25 aa, Homo sapiens
TTTTATGACTTCCTTCGGGAGTTCT

SEQ ID NO: 1568 - protein, 25 aa, Homo sapiens
TTGTTCTACTTGTTCAGCCTGAAGG

SEQ ID NO: 1569 - protein, 25 aa, Homo sapiens
CCAGTTTCTCAGTAAGGTGCTTATT

SEQ ID NO: 1570 - protein, 25 aa, Homo sapiens
ACGGAAGAGGCGCACCAGTTTCTCA

SEQ ID NO: 1571 - protein, 25 aa, Homo sapiens
AAGGTGCTTATTGGTATCTTTACTT

SEQ ID NO: 1572 - protein, 25 aa, Homo sapiens
GGAAGTTGATAGAAGAACTATACGG

SEQ ID NO: 1573 - protein, 25 aa, Homo sapiens
ACTATACGGGGAAACCATAAATTGG

SEQ ID NO: 1574 - protein, 25 aa, Homo sapiens
ACTGAGGCATTGTCTAAGACCTGGT

SEQ ID NO: 1575 - protein, 25 aa, Homo sapiens
GTCTAAGACCTGGTTGGAAGTTGAT

SEQ ID NO: 1576 - protein, 25 aa, Homo sapiens
TACTTCTCTCACTGTTGCTTTTCCT

SEQ ID NO: 1577 - protein, 25 aa, Homo sapiens
ACTTCTCTCACTGTTGCTTTTCCTT

SEQ ID NO: 1578 - protein, 25 aa, Homo sapiens
TTACTTCTCTCACTGTTGCTTTTCC

SEQ ID NO: 1579 - protein, 25 aa, Homo sapiens
CTTCTCTCACTGTTGCTTTTCCTTT

SEQ ID NO: 1580 - protein, 25 aa, Homo sapiens
AAGTCTCCCCTATACTAAGCCTAGG

SEQ ID NO: 1581 - protein, 25 aa, Homo sapiens
AAGACTAAGTCTCCCCTATACTAAG

SEQ ID NO: 1582 - protein, 25 aa, Homo sapiens
CTATACTAAGCCTAGGACACTTCCG

SEQ ID NO: 1583 - protein, 25 aa, Homo sapiens
TAATTAATTTCAAGACTAAGTCTCC

SEQ ID NO: 1584 - protein, 25 aa, Homo sapiens
CTCTGAAAAAACTTGAGTCTGAATT

SEQ ID NO: 1585 - protein, 25 aa, Homo sapiens
TTAGTCCGAGCGAAATAGAATCTCT

SEQ ID NO: 1586 - protein, 25 aa, Homo sapiens
TTACCGAGGATCCTTACGAACCACG

SEQ ID NO: 1587 - protein, 25 aa, Homo sapiens
CGAAAAACTGGTGCATCCGACAAAT

SEQ ID NO: 1588 - protein, 25 aa, Homo sapiens
TGTTTCAGAAGTTTGAGGTTTGATC

SEQ ID NO: 1589 - protein, 25 aa, Homo sapiens
GGAGGAGAGTATTGTCTGATATCCC

SEQ ID NO: 1590 - protein, 25 aa, Homo sapiens
CGTCTCTCTCAACCTGATGTGTTTC

SEQ ID NO: 1591 - protein, 25 aa, Homo sapiens
CTGATATCCCTTATGGTATGTCTAT

SEQ ID NO: 1592 - protein, 25 aa, Homo sapiens
ACCGAGGTTTAGTTATACACTAATC

SEQ ID NO: 1593 - protein, 25 aa, Homo sapiens
TGTTGGTAACTTTAGAGTCTCGAAG

SEQ ID NO: 1594 - protein, 25 aa, Homo sapiens
AGTTCCCATGATAACTTCTTGACCG

SEQ ID NO: 1595 - protein, 25 aa, Homo sapiens
AGTCTCGAAGGGCAGTCTTGTACCT

SEQ ID NO: 1596 - protein, 25 aa, Homo sapiens
GCACAACTCGGACTTACCATGTAAG

SEQ ID NO: 1597 - protein, 25 aa, Homo sapiens
CATGACCCACCAGGACGTTTTAGGG

SEQ ID NO: 1598 - protein, 25 aa, Homo sapiens
CCGAGCTAACAATAAAGGTGGTTTT

SEQ ID NO: 1599 - protein, 25 aa, Homo sapiens
GGGTTGAAACTACACGCACTTTAAC

SEQ ID NO: 1600 - protein, 25 aa, Homo sapiens
CGTTCCTAAGACGATCAGGTGCTAT

SEQ ID NO: 1601 - protein, 25 aa, Homo sapiens
CTGGTAATAGTTAAACCGAGTCTTA

SEQ ID NO: 1602 - protein, 25 aa, Homo sapiens
GTCGGGTAACCAGTCAAACCATGGT

SEQ ID NO: 1603 - protein, 25 aa, Homo sapiens
GGTCCGATGTACCACCGTTCCTAAG

SEQ ID NO: 1604 - protein, 25 aa, Homo sapiens
CTTCATTTCCAACGGGTTAATCGAC

SEQ ID NO: 1605 - protein, 25 aa, Homo sapiens
ACTGTTCGCTCTTCATTTCCAACGG

SEQ ID NO: 1606 - protein, 25 aa, Homo sapiens
ACAAATGAACGAAGTTTGCCTTACT

SEQ ID NO: 1607 - protein, 25 aa, Homo sapiens
GTTTGCCTTACTGTTCGCTCTTCAT

SEQ ID NO: 1608 - protein, 25 aa, Homo sapiens
AGTTTAAGACTATTGCTCTCTAGAT

SEQ ID NO: 1609 - protein, 25 aa, Homo sapiens
TCTAGATAGGGAAGATACCACCTAC

SEQ ID NO: 1610 - protein, 25 aa, Homo sapiens
GAAGTAGTTGTTCCTTGAATAGAAC

SEQ ID NO: 1611 - protein, 25 aa, Homo sapiens
AGACTGTATATTACTGAAGTAGTTG

SEQ ID NO: 1612 - protein, 25 aa, Homo sapiens
CTACTAGCTTTCCTTACCAATTGAT

SEQ ID NO: 1613 - protein, 25 aa, Homo sapiens
GTTGCTTTCAATGAACCCGAAGGAC

SEQ ID NO: 1614 - protein, 25 aa, Homo sapiens
CAATTGATTAAAGTACCTCCTATCT

SEQ ID NO: 1615 - protein, 25 aa, Homo sapiens
TTGTCTATCTACTAGCTTTCCTTAC

SEQ ID NO: 1616 - protein, 25 aa, Homo sapiens
GGTCGTGTAGTTTCCTTCGATTTCT

SEQ ID NO: 1617 - protein, 25 aa, Homo sapiens
CTTTTCTGTAGCATAGGTCAAGTTT

SEQ ID NO: 1618 - protein, 25 aa, Homo sapiens
CTTCGATTTCTTATGAAACGTCTAT

SEQ ID NO: 1619 - protein, 25 aa, Homo sapiens
AGCATAGGTCAAGTTTATAAGACCA

SEQ ID NO: 1620 - protein, 25 aa, Homo sapiens
TTCTCACCTTCTCAAGATGAGGTTT

SEQ ID NO: 1621 - protein, 25 aa, Homo sapiens
TCTCACCTTCTCAAGATGAGGTTTA

SEQ ID NO: 1622 - protein, 25 aa, Homo sapiens
CTTCTCACCTTCTCAAGATGAGGTT

SEQ ID NO: 1623 - protein, 25 aa, Homo sapiens
AGACGCTGTAGCAAAAGACCTCCTT

SEQ ID NO: 1624 - protein, 25 aa, Homo sapiens
ACGCTGTAGCAAAAGACCTCCTTAA

SEQ ID NO: 1625 - protein, 25 aa, Homo sapiens
ACCGGGAGAGAAGACGCTGTAGCAA

SEQ ID NO: 1626 - protein, 25 aa, Homo sapiens
GAGAGAAGACGCTGTAGCAAAAGAC

SEQ ID NO: 1627 - protein, 25 aa, Homo sapiens
TTATAGTAGTTCTAACACCCAGAAG

SEQ ID NO: 1628 - protein, 25 aa, Homo sapiens
GTAACTTCTGCGAAGCAATACCCTT

SEQ ID NO: 1629 - protein, 25 aa, Homo sapiens
TTCTAACACCCAGAAGTCATGTTCT

SEQ ID NO: 1630 - protein, 25 aa, Homo sapiens
CTAAGTAACTTCTGCGAAGCAATAC

SEQ ID NO: 1631 - protein, 25 aa, Homo sapiens
ACAAGCTCTTCGAAGAGTATTCGTC

SEQ ID NO: 1632 - protein, 25 aa, Homo sapiens
ACCCTCTCTGTTTATACCCCAAAAG

SEQ ID NO: 1633 - protein, 25 aa, Homo sapiens
TTTTATGAGTTACAAGCTCTTCGAA

SEQ ID NO: 1634 - protein, 25 aa, Homo sapiens
ACTCCCTCTAAGTCGGTTTTGAAAC

SEQ ID NO: 1635 - protein, 25 aa, Homo sapiens
CCCTCTAAGTCGGTTTTGAAACCGA

SEQ ID NO: 1636 - protein, 25 aa, Homo sapiens
GAGGTGACTCACATGCGAATAGGAC

SEQ ID NO: 1637 - protein, 25 aa, Homo sapiens
GCGAATAGGACTGACTCCCTCTAAG

SEQ ID NO: 1638 - protein, 25 aa, Homo sapiens
CTTAGTTCCCTTAAGGGTTTGAGCT

SEQ ID NO: 1639 - protein, 25 aa, Homo sapiens
CAATTTGTTCTTCACAAGTCGACAT

SEQ ID NO: 1640 - protein, 25 aa, Homo sapiens
GTAACCGACACCATAACATCTTTCG

SEQ ID NO: 1641 - protein, 25 aa, Homo sapiens
ACATCTTTCGTATGATTTGACCCAC

SEQ ID NO: 1642 - protein, 25 aa, Homo sapiens
AACTTTTGGGTTGGAAACTGAGAGT

SEQ ID NO: 1643 - protein, 25 aa, Homo sapiens
TTTTGTACTGAAATGTTGGGTTCTC

SEQ ID NO: 1644 - protein, 25 aa, Homo sapiens
TTGGGTTGGAAACTGAGAGTCTGTT

SEQ ID NO: 1645 - protein, 25 aa, Homo sapiens
ACATTTACGGAATTAACTTTTGGGT

SEQ ID NO: 1646 - protein, 25 aa, Homo sapiens
ACCACAACGTCATTTTCGTGTAGTC

SEQ ID NO: 1647 - protein, 25 aa, Homo sapiens
CTAACACTGATTTGAACAACTACAA

SEQ ID NO: 1648 - protein, 25 aa, Homo sapiens
TGTTCCCACCACAACGTCATTTTCG

SEQ ID NO: 1649 - protein, 25 aa, Homo sapiens
CGACTAGTCTAACACTGATTTGAAC

SEQ ID NO: 1650 - protein, 25 aa, Homo sapiens
GGTGTCCACCCTTCACACAAATTGA

SEQ ID NO: 1651 - protein, 25 aa, Homo sapiens
TTTCCTAAAGCATCAATACACCTGT

SEQ ID NO: 1652 - protein, 25 aa, Homo sapiens
GTTCAACCTACTTTGACCATTGAGG

SEQ ID NO: 1653 - protein, 25 aa, Homo sapiens
TCCGAAAGTCGTTTAATCGAAACAG

SEQ ID NO: 1654 - protein, 25 aa, Homo sapiens
ATATGTACATAGTGGAAAGTCGGAC

SEQ ID NO: 1655 - protein, 25 aa, Homo sapiens
ATAACGACCTAGGTGGTTTCTACAG

SEQ ID NO: 1656 - protein, 25 aa, Homo sapiens
TTACGTTTCGGACCTGTTTCTATAA

SEQ ID NO: 1657 - protein, 25 aa, Homo sapiens
AACAACGTGATTACCAGTCTTCTCG

SEQ ID NO: 1658 - protein, 25 aa, Homo sapiens
CCGATACCTCGGTTTAACACATTGT

SEQ ID NO: 1659 - protein, 25 aa, Homo sapiens
CATTGTATAAGTCATGGTTTAAATG

SEQ ID NO: 1660 - protein, 25 aa, Homo sapiens
ACCGATACCTCGGTTTAACACATTG

SEQ ID NO: 1661 - protein, 25 aa, Homo sapiens
ACTTTTCTACATACAGGGTCGAGAG

SEQ ID NO: 1662 - protein, 25 aa, Homo sapiens
AAACCTGTCGAGGATTGAAGATCAT

SEQ ID NO: 1663 - protein, 25 aa, Homo sapiens
GTCGAGGATTGAAGATCATTGATAC

SEQ ID NO: 1664 - protein, 25 aa, Homo sapiens
GAGTATAAACCTGTCGAGGATTGAA

SEQ ID NO: 1665 - protein, 25 aa, Homo sapiens
GAACATAATCTCAGTGTTAACTAGG

SEQ ID NO: 1666 - protein, 25 aa, Homo sapiens
CCTGGGTTTTTACAGAACATAATCT

SEQ ID NO: 1667 - protein, 25 aa, Homo sapiens
ATTACGACGCCTGTTGTTTGTTTCC

SEQ ID NO: 1668 - protein, 25 aa, Homo sapiens
ACGCCTGTTGTTTGTTTCCCTGGGT

SEQ ID NO: 1669 - protein, 25 aa, Homo sapiens
GCGGGTCTGTGGATGTAACCAAGAC

SEQ ID NO: 1670 - protein, 25 aa, Homo sapiens
GTGGATGTAACCAAGACACCTTAAT

SEQ ID NO: 1671 - protein, 25 aa, Homo sapiens
ACCAAGACACCTTAATCACTGGGTC

SEQ ID NO: 1672 - protein, 25 aa, Homo sapiens
CTTGTATAAAACGAGGCGGGTCTGT

SEQ ID NO: 1673 - protein, 25 aa, Homo sapiens
AGAACTCGGGGAAGTGCTGGCAGTG

SEQ ID NO: 1674 - protein, 25 aa, Homo sapiens
AAGAACTCGGGGAAGTGCTGGCAGT

SEQ ID NO: 1675 - protein, 25 aa, Homo sapiens
GAACTCGGGGAAGTGCTGGCAGTGG

SEQ ID NO: 1676 - protein, 25 aa, Homo sapiens
CAAGAACTCGGGGAAGTGCTGGCAG

SEQ ID NO: 1677 - protein, 25 aa, Homo sapiens
CAGGACGGACAAATCAGCGAAAGTC

SEQ ID NO: 1678 - protein, 25 aa, Homo sapiens
CCCAGGACGGACAAATCAGCGAAAG

SEQ ID NO: 1679 - protein, 25 aa, Homo sapiens
AAGTTCACCTCGAGAGGATTGGCTG

SEQ ID NO: 1680 - protein, 25 aa, Homo sapiens
TTGGCTGCGCGCAGACACCTCTTCG

SEQ ID NO: 1681 - protein, 25 aa, Homo sapiens
AATTTATCCTTAAGTATGGTCCCTG

SEQ ID NO: 1682 - protein, 25 aa, Homo sapiens
TTATCCTTAAGTATGGTCCCTGTTT

SEQ ID NO: 1683 - protein, 25 aa, Homo sapiens
ATCCTTAAGTATGGTCCCTGTTTCG

SEQ ID NO: 1684 - protein, 25 aa, Homo sapiens
CCTTAAGTATGGTCCCTGTTTCGTC

SEQ ID NO: 1685 - protein, 25 aa, Homo sapiens
ACCGTTAGTTATGTCGAAGTAATAG

SEQ ID NO: 1686 - protein, 25 aa, Homo sapiens
ATCCTCCGGGGGGCACACCTGTGTC

SEQ ID NO: 1687 - protein, 25 aa, Homo sapiens
GCGGTTTAGGCGTGGTTCCAGTACC

SEQ ID NO: 1688 - protein, 25 aa, Homo sapiens
TCGGCGGTTTAGGCGTGGTTCCAGT

SEQ ID NO: 1689 - protein, 25 aa, Homo sapiens
CGGTTTAGGCGTGGTTCCAGTACCT

SEQ ID NO: 1690 - protein, 25 aa, Homo sapiens
AGGTCGGCGGTTTAGGCGTGGTTCC

SEQ ID NO: 1691 - protein, 25 aa, Homo sapiens
ACCCTCGGGAGCAGACTTTCTTTAC

SEQ ID NO: 1692 - protein, 25 aa, Homo sapiens
ACTCGAGATCACGACAGTGGGTCAA

SEQ ID NO: 1693 - protein, 25 aa, Homo sapiens
GAGAACGAAGATGCACCACAGACAC

SEQ ID NO: 1694 - protein, 25 aa, Homo sapiens
GACTCTGGTGAGGTAACCCACTTAT

SEQ ID NO: 1695 - protein, 25 aa, Homo sapiens
GACCTCCTCTGGTTTCCAGCGATGA

SEQ ID NO: 1696 - protein, 25 aa, Homo sapiens
TCTAGGTCCTCTACTAACCGTCGCA

SEQ ID NO: 1697 - protein, 25 aa, Homo sapiens
TCCTCTGGTTTCCAGCGATGACGTA

SEQ ID NO: 1698 - protein, 25 aa, Homo sapiens
CTGGTTTCCAGCGATGACGTACGTC

SEQ ID NO: 1699 - protein, 25 aa, Homo sapiens
GTTCTCGCTCTAGAGCCTCGAGGCC

SEQ ID NO: 1700 - protein, 25 aa, Homo sapiens
CGTCTTGGACCTCTAACTCGACGTC

SEQ ID NO: 1701 - protein, 25 aa, Homo sapiens
ACCGGTGGTTGTCGCTCGACCACGT

SEQ ID NO: 1702 - protein, 25 aa, Homo sapiens
CCTCGAGGCCGCGTGGTACGTCTTG

SEQ ID NO: 1703 - protein, 25 aa, Homo sapiens
CCTCTACCTGCGACGTGGACCGCAC

SEQ ID NO: 1704 - protein, 25 aa, Homo sapiens
CGGTCCACCCACCTCTACAGTTACA

SEQ ID NO: 1705 - protein, 25 aa, Homo sapiens
CTACTTACGGGACTCTCCGGTCCAC

SEQ ID NO: 1706 - protein, 25 aa, Homo sapiens
AGACTTGCTCTACGCACTGGTCATA

SEQ ID NO: 1707 - protein, 25 aa, Homo sapiens
CACAGAGTATGGAAAAGAGACCCCA

SEQ ID NO: 1708 - protein, 25 aa, Homo sapiens
CTACCCACAGAGTATGGAAAAGAGA

SEQ ID NO: 1709 - protein, 25 aa, Homo sapiens
ATGGAAAAGAGACCCCAGTAAGGTC

SEQ ID NO: 1710 - protein, 25 aa, Homo sapiens
AGTATGGAAAAGAGACCCCAGTAAG

SEQ ID NO: 1711 - protein, 25 aa, Homo sapiens
TCGGTGTCACCTGTTACGGTTACAG

SEQ ID NO: 1712 - protein, 25 aa, Homo sapiens
ACTGTTACGGGCAGACCGGCGCCTA

SEQ ID NO: 1713 - protein, 25 aa, Homo sapiens
ACCGGCGCCTACTGAAGGCGTGGTT

SEQ ID NO: 1714 - protein, 25 aa, Homo sapiens
CGGTTACAGGAAGACGTCTAACTGT

SEQ ID NO: 1715 - protein, 25 aa, Homo sapiens
ACCCCCTCCTATACCACCACCGGAA

SEQ ID NO: 1716 - protein, 25 aa, Homo sapiens
CCGAAACCACCACCGAAACGACCAC

SEQ ID NO: 1717 - protein, 25 aa, Homo sapiens
ACCGGAACCACGACCGAACCCACCA

SEQ ID NO: 1718 - protein, 25 aa, Homo sapiens
GAAACGACCACCACTACCCGAAGAC

SEQ ID NO: 1719 - protein, 25 aa, Homo sapiens
TGAGTCGGTTGACGAGCGAGCGAGT

SEQ ID NO: 1720 - protein, 25 aa, Homo sapiens
AAGAGAAGTGAGTCGGTTGACGAGC

SEQ ID NO: 1721 - protein, 25 aa, Homo sapiens
AAGTGAGTCGGTTGACGAGCGAGCG

SEQ ID NO: 1722 - protein, 25 aa, Homo sapiens
TGGGCTCGTGGAAGAGAAGTGAGTC

SEQ ID NO: 1723 - protein, 25 aa, Homo sapiens
CTCTTCCACTGGTACGTCTTGGAGT

SEQ ID NO: 1724 - protein, 25 aa, Homo sapiens
CACTGGTACGTCTTGGAGTTACTGG

SEQ ID NO: 1725 - protein, 25 aa, Homo sapiens
TTCCACTGGTACGTCTTGGAGTTAC

SEQ ID NO: 1726 - protein, 25 aa, Homo sapiens
CGTCTTGGAGTTACTGGCGGACCGG

SEQ ID NO: 1727 - protein, 25 aa, Homo sapiens
CGTCGCCAACCGCCCGCCCAGGAGG

SEQ ID NO: 1728 - protein, 25 aa, Homo sapiens
GACGCCGGAGGAACGGGCCCGAACC

SEQ ID NO: 1729 - protein, 25 aa, Homo sapiens
GCCCAGGAGGCGACAACGCCGGCGA

SEQ ID NO: 1730 - protein, 25 aa, Homo sapiens
CCGCCGCGCCTGCCGTCGCCAACCG

SEQ ID NO: 1731 - protein, 25 aa, Homo sapiens
ACTCTGGACCCTCATGCAACACGGT

SEQ ID NO: 1732 - protein, 25 aa, Homo sapiens
TGTGTAACCGCACTCTGGACCCTCA

SEQ ID NO: 1733 - protein, 25 aa, Homo sapiens
TGTAACCGCACTCTGGACCCTCATG

SEQ ID NO: 1734 - protein, 25 aa, Homo sapiens
CCTCATGCAACACGGTTTAGTAACG

SEQ ID NO: 1735 - protein, 25 aa, Homo sapiens
ACCGGGCTTGGCGCTGAAGTTGTTT

SEQ ID NO: 1736 - protein, 25 aa, Homo sapiens
ACACGTTTAGGAGAGAGATCTCCTT

SEQ ID NO: 1737 - protein, 25 aa, Homo sapiens
TTCCTTATAAAAGATCGACACGTTT

SEQ ID NO: 1738 - protein, 25 aa, Homo sapiens
AAACCGGGCTTGGCGCTGAAGTTGT

SEQ ID NO: 1739 - protein, 25 aa, Homo sapiens
TGTCAACTTCGGGTCGGGTGAGAAT

SEQ ID NO: 1740 - protein, 25 aa, Homo sapiens
AAGGGCACATCTAAAGACTATGAAG

SEQ ID NO: 1741 - protein, 25 aa, Homo sapiens
CAAAGAATTAGTCACGGTACGGTCC

SEQ ID NO: 1742 - protein, 25 aa, Homo sapiens
GGTTTGCTCCGTAAGACACTCTAGA

SEQ ID NO: 1743 - protein, 25 aa, Homo sapiens
TTCCGTTTATTGACTACTGGTCCGC

SEQ ID NO: 1744 - protein, 25 aa, Homo sapiens
TGCAGACACTGTCCGGGTAGTTAAA

SEQ ID NO: 1745 - protein, 25 aa, Homo sapiens
TGGTCCGCCGTGTAACAAGACGAGG

SEQ ID NO: 1746 - protein, 25 aa, Homo sapiens
CGGACAGTGAGATTTGGTCGCAAAT

SEQ ID NO: 1747 - protein, 25 aa, Homo sapiens
CCACGTAGACAGCACTCTTAAGGGT

SEQ ID NO: 1748 - protein, 25 aa, Homo sapiens
CGTGGCCCTTCCACATCTAGTAGAT

SEQ ID NO: 1749 - protein, 25 aa, Homo sapiens
ACTAGGGCGCATCAGGTTCCGTAAC

SEQ ID NO: 1750 - protein, 25 aa, Homo sapiens
TCGACGGAGACTTCGAGCGAACCAG

SEQ ID NO: 1751 - protein, 25 aa, Homo sapiens
GAGTGTGAAAGGGACGCCGACCCTT

SEQ ID NO: 1752 - protein, 25 aa, Homo sapiens
AGTGTGAAAGGGACGCCGACCCTTC

SEQ ID NO: 1753 - protein, 25 aa, Homo sapiens
CATTGGAGTCCGTCTACTTAAGGAT

SEQ ID NO: 1754 - protein, 25 aa, Homo sapiens
TGGTCCCAAGAACGACGGACATTGG

SEQ ID NO: 1755 - protein, 25 aa, Homo sapiens
ACTTTTACAGAACCGCCGCAACCGA

SEQ ID NO: 1756 - protein, 25 aa, Homo sapiens
CACATTGCAGCTAAAACAGAGACGT

SEQ ID NO: 1757 - protein, 25 aa, Homo sapiens
TTGCGCTTAGGGGACTCGACTTCCT

SEQ ID NO: 1758 - protein, 25 aa, Homo sapiens
ATAAGAACTGCGGGTCTTACCAGTC

SEQ ID NO: 1759 - protein, 25 aa, Homo sapiens
CTTAAACGGGGATCTTGGTGAGGAT

SEQ ID NO: 1760 - protein, 25 aa, Homo sapiens
TGAGGATAAGAACTGCGGGTCTTAC

SEQ ID NO: 1761 - protein, 25 aa, Homo sapiens
GAGACGTATTGAATCCGGCCCGACT

SEQ ID NO: 1762 - protein, 25 aa, Homo sapiens
TAGTAGAACCTACCGCAGCAGGAAC

SEQ ID NO: 1763 - protein, 25 aa, Homo sapiens
CCGTGGGTAACAAACTCCGTGACAG

SEQ ID NO: 1764 - protein, 25 aa, Homo sapiens
CGTAATACGGGCGACTCAACACTAT

SEQ ID NO: 1765 - protein, 25 aa, Homo sapiens
TGTCTGCCAGCGAAGCGCACCGAGA

SEQ ID NO: 1766 - protein, 25 aa, Homo sapiens
CCAAGGACGCCGTGGGGACCTTCTT

SEQ ID NO: 1767 - protein, 25 aa, Homo sapiens
CTTGACCGGATGTCTGCCAGCGAAG

SEQ ID NO: 1768 - protein, 25 aa, Homo sapiens
GAGACCTGCAAGACTCGCTCCCGAG

SEQ ID NO: 1769 - protein, 25 aa, Homo sapiens
CGGTACACACGTTGTTTCGGACAGT

SEQ ID NO: 1770 - protein, 25 aa, Homo sapiens
GGTCTACAGAAGGAACGGGCCTAAG

SEQ ID NO: 1771 - protein, 25 aa, Homo sapiens
CAACCCGTCAAGGTCTGGAGTGTCC

SEQ ID NO: 1772 - protein, 25 aa, Homo sapiens
CTCGTACAGAGGAGCGGGACACTAA

SEQ ID NO: 1773 - protein, 25 aa, Homo sapiens
TCTCAGGTACCCCAGATTAAGGTAC

SEQ ID NO: 1774 - protein, 25 aa, Homo sapiens
CCTTCTGCTCCTCGGTGGTTCTCAG

SEQ ID NO: 1775 - protein, 25 aa, Homo sapiens
ACGGTCAGAAGGCTTCTCAGGTACC

SEQ ID NO: 1776 - protein, 25 aa, Homo sapiens
CCCCAGATTAAGGTACGCAAGATAG

SEQ ID NO: 1777 - protein, 25 aa, Homo sapiens
CCTTACGATCAGACCGTATTTGTAT

SEQ ID NO: 1778 - protein, 25 aa, Homo sapiens
ACTTCATCCTTACGATCAGACCGTA

SEQ ID NO: 1779 - protein, 25 aa, Homo sapiens
CATCCTTACGATCAGACCGTATTTG

SEQ ID NO: 1780 - protein, 25 aa, Homo sapiens
ATCCTTACGATCAGACCGTATTTGT

SEQ ID NO: 1781 - protein, 25 aa, Homo sapiens
TTTCGCAGTCCGTCTCTCTATTCTT

SEQ ID NO: 1782 - protein, 25 aa, Homo sapiens
CAGTTTTCGCAGTCCGTCTCTCTAT

SEQ ID NO: 1783 - protein, 25 aa, Homo sapiens
TCGTTCACACGATATGTAGCTTCCT

SEQ ID NO: 1784 - protein, 25 aa, Homo sapiens
TCCTGTGTACTTGGGCTTTTACTTT

SEQ ID NO: 1785 - protein, 25 aa, Homo sapiens
CCGACCACACAGAGGGAGTAGTGGC

SEQ ID NO: 1786 - protein, 25 aa, Homo sapiens
TTCGGTCCCTCCTGAAGTTGGTCCT

SEQ ID NO: 1787 - protein, 25 aa, Homo sapiens
GTAGTGGCTGATGTCCCAGGCCAAT

SEQ ID NO: 1788 - protein, 25 aa, Homo sapiens
CCTGAAGTTGGTCCTGTAGCCGACC

SEQ ID NO: 1789 - protein, 25 aa, Homo sapiens
GGCTTTTAGGTAGGTCGTCCTGCAG

SEQ ID NO: 1790 - protein, 25 aa, Homo sapiens
AACCCCTGGTTCGAAGGAGTTGACT

SEQ ID NO: 1791 - protein, 25 aa, Homo sapiens
CGAAGGAGTTGACTCGTTCCCCTCG

SEQ ID NO: 1792 - protein, 25 aa, Homo sapiens
GAACCCCTGGTTCGAAGGAGTTGAC

SEQ ID NO: 1793 - protein, 25 aa, Homo sapiens
GTGGACGCCCGGTAGGATTTCTCGT

SEQ ID NO: 1794 - protein, 25 aa, Homo sapiens
ACTTCATGGACGTCCCGCAGATGGT

SEQ ID NO: 1795 - protein, 25 aa, Homo sapiens
AGTAAGACCTGCACGAAGACGGGCT

SEQ ID NO: 1796 - protein, 25 aa, Homo sapiens
ACTCGAGGTCGGTCATGCACTGGAC

SEQ ID NO: 1797 - protein, 25 aa, Homo sapiens
ACGAACAGTGTCGATTCCCACGAAG

SEQ ID NO: 1798 - protein, 25 aa, Homo sapiens
CTCTGAGACGAGACTTGGCTTACCT

SEQ ID NO: 1799 - protein, 25 aa, Homo sapiens
AAGAATTGGCGTCCGGTGAACCCCG

SEQ ID NO: 1800 - protein, 25 aa, Homo sapiens
GTCCCTAAGTACCTGATCCAAACGT

SEQ ID NO: 1801 - protein, 25 aa, Homo sapiens
ACCTGCTCCACCTGATGTTCTGCCG

SEQ ID NO: 1802 - protein, 25 aa, Homo sapiens
GTAGTTCCCCGGAAGCGACTCGATG

SEQ ID NO: 1803 - protein, 25 aa, Homo sapiens
TTCTGCCGACTCCTCTTCATGTAGT

SEQ ID NO: 1804 - protein, 25 aa, Homo sapiens
CGGTAGTAGACACGCTAGAGACGCC

SEQ ID NO: 1805 - protein, 25 aa, Homo sapiens
CCGGGTCGACCGAATGGTTTTGTCC

SEQ ID NO: 1806 - protein, 25 aa, Homo sapiens
CTCGCGGATTAGGACAGAGACCCGT

SEQ ID NO: 1807 - protein, 25 aa, Homo sapiens
AAAGGACGACCTAGAAGTACCAAGG

SEQ ID NO: 1808 - protein, 25 aa, Homo sapiens
TGTAGGCACACGAATCGACGGGAAC

SEQ ID NO: 1809 - protein, 25 aa, Homo sapiens
GGGCAATCCTCAAGTAGTGTCGAAG

SEQ ID NO: 1810 - protein, 25 aa, Homo sapiens
AACGGCTGTAGTTTTGGGCAATCCT

SEQ ID NO: 1811 - protein, 25 aa, Homo sapiens
GCGGCCCCTGTACGAGTTTTATTGT

SEQ ID NO: 1812 - protein, 25 aa, Homo sapiens
GGTCAACGGTACTTTCGGAGGGCAC

SEQ ID NO: 1813 - protein, 25 aa, Homo sapiens
CTTTATAAACTGTTGGTCGAGGAAC

SEQ ID NO: 1814 - protein, 25 aa, Homo sapiens
TCTTTATAAACTGTTGGTCGAGGAA

SEQ ID NO: 1815 - protein, 25 aa, Homo sapiens
CGAGGAACTTCTCGCCTTGGCCGCG

SEQ ID NO: 1816 - protein, 25 aa, Homo sapiens
AACTTCTCGCCTTGGCCGCGGCAGC

SEQ ID NO: 1817 - protein, 25 aa, Homo sapiens
GACCGCCACCTTCGCGGAGGTCACA

SEQ ID NO: 1818 - protein, 25 aa, Homo sapiens
GGACCGCCACCTTCGCGGAGGTCAC

SEQ ID NO: 1819 - protein, 25 aa, Homo sapiens
CGGACCGCCACCTTCGCGGAGGTCA

SEQ ID NO: 1820 - protein, 25 aa, Homo sapiens
CCGCCACCTTCGCGGAGGTCACACG

SEQ ID NO: 1821 - protein, 25 aa, Homo sapiens
CCTCTTAGGTAAAGCAATTGTGACT

SEQ ID NO: 1822 - protein, 25 aa, Homo sapiens
CGACACCAAAGAGGGCTGCACGTGT

SEQ ID NO: 1823 - protein, 25 aa, Homo sapiens
CTTCGCATAAGTGACACGCGGTCAT

SEQ ID NO: 1824 - protein, 25 aa, Homo sapiens
CTAGAGCATACACACCGTAGACTAT

SEQ ID NO: 1825 - protein, 25 aa, Homo sapiens
GGCGGACGCTGTCAAGGTCTTAAAC

SEQ ID NO: 1826 - protein, 25 aa, Homo sapiens
TCTTAAACGAGAGGGTGAGTCACAC

SEQ ID NO: 1827 - protein, 25 aa, Homo sapiens
TCAGTGGCGCCAGAGTCAGTAGCCG

SEQ ID NO: 1828 - protein, 25 aa, Homo sapiens
GCGTCGGAAACATACCTCCGGGTTG

SEQ ID NO: 1829 - protein, 25 aa, Homo sapiens
AAACTCCCCGACACTGGGAGAAGGG

SEQ ID NO: 1830 - protein, 25 aa, Homo sapiens
TACAGGTCCCAAGGTCCCGGGCCAC

SEQ ID NO: 1831 - protein, 25 aa, Homo sapiens
ACGAAACTCCCCGACACTGGGAGAA

SEQ ID NO: 1832 - protein, 25 aa, Homo sapiens
CGGAACGAAACTCCCCGACACTGGG

SEQ ID NO: 1833 - protein, 25 aa, Homo sapiens
GTCGGCTGCTGTCGGTGGCCTCTCC

SEQ ID NO: 1834 - protein, 25 aa, Homo sapiens
CTCCTCTAGCCTTGTGCTAACAGAG

SEQ ID NO: 1835 - protein, 25 aa, Homo sapiens
TTCCTGAGAGCATAGCCCGGGAACC

SEQ ID NO: 1836 - protein, 25 aa, Homo sapiens
CCTGCTTCGGCGTTCCTGAGAGCAT

SEQ ID NO: 1837 - protein, 25 aa, Homo sapiens
GTCCTTTGGGCCGGCACCGGACCGT

SEQ ID NO: 1838 - protein, 25 aa, Homo sapiens
ACTGGAAACAAAGTGAACGGAGACG

SEQ ID NO: 1839 - protein, 25 aa, Homo sapiens
GAGCTGAGGCTCTCGTCCTTTGGGC

SEQ ID NO: 1840 - protein, 25 aa, Homo sapiens
TGAACGGAGACGAGCTGAGGCTCTC

SEQ ID NO: 1841 - protein, 25 aa, Homo sapiens
CGCCCCGAGTCGTCGCAACGTACAT

SEQ ID NO: 1842 - protein, 25 aa, Homo sapiens
GCCGGTCATGGTGGCGGACTCCGCC

SEQ ID NO: 1843 - protein, 25 aa, Homo sapiens
GGGACGACCAGCGACAAAGCCCCTG

SEQ ID NO: 1844 - protein, 25 aa, Homo sapiens
CCTCGTCACCCCGTGTGGGGCCTCC

SEQ ID NO: 1845 - protein, 25 aa, Homo sapiens
AGTACCTTTTAGGAGGCCTCGGCGG

SEQ ID NO: 1846 - protein, 25 aa, Homo sapiens
GCCCGGAGCATGACGGAGTACCTTT

SEQ ID NO: 1847 - protein, 25 aa, Homo sapiens
ACGGAGTACCTTTTAGGAGGCCTCG

SEQ ID NO: 1848 - protein, 25 aa, Homo sapiens
AGCATGACGGAGTACCTTTTAGGAG

SEQ ID NO: 1849 - protein, 25 aa, Homo sapiens
GGAACGGTTCAACAAGCTCCACCTT

SEQ ID NO: 1850 - protein, 25 aa, Homo sapiens
CTCCACCTTAATTTGTGGAGGGTCT

SEQ ID NO: 1851 - protein, 25 aa, Homo sapiens
CTCATCCTGTGTAACGGTACCAAAA

SEQ ID NO: 1852 - protein, 25 aa, Homo sapiens
GACGACAACACTTCATGAAAATAGG

SEQ ID NO: 1853 - protein, 25 aa, Homo sapiens
TAAGCGGAACCGGTTGGGAAGAAAC

SEQ ID NO: 1854 - protein, 25 aa, Homo sapiens
GATCGTTGAGGGATCACCGCAAAAA

SEQ ID NO: 1855 - protein, 25 aa, Homo sapiens
AAATTGTCTACTGCCTCTATTAGGG

SEQ ID NO: 1856 - protein, 25 aa, Homo sapiens
GGGAAGAAACACATAGTCCATCAGA

SEQ ID NO: 1857 - protein, 25 aa, Homo sapiens
CCTCATCTACCAACATCTAACTGAT

SEQ ID NO: 1858 - protein, 25 aa, Homo sapiens
TATGATGGTCAGTTGTAGAAAAACC

SEQ ID NO: 1859 - protein, 25 aa, Homo sapiens
AGATGGTATGAAGTTCCCTGATGTC

SEQ ID NO: 1860 - protein, 25 aa, Homo sapiens
TAAGTTCTATGATGGTCAGTTGTAG

SEQ ID NO: 1861 - protein, 25 aa, Homo sapiens
CGGTTACTGGTCGTCAACCATACTT

SEQ ID NO: 1862 - protein, 25 aa, Homo sapiens
AGAAACAATACAGGGTCTTGACTAC

SEQ ID NO: 1863 - protein, 25 aa, Homo sapiens
AGGGAGCGTCAACACCTGTAAAGAC

SEQ ID NO: 1864 - protein, 25 aa, Homo sapiens
ACAGGTCTATGGTAAAGAGGATCAT

SEQ ID NO: 1865 - protein, 25 aa, Homo sapiens
AAACCTAATATGGAGTGGTCGACGT

SEQ ID NO: 1866 - protein, 25 aa, Homo sapiens
AGAGGGTTCCCGCTTTCAGTAACCT

SEQ ID NO: 1867 - protein, 25 aa, Homo sapiens
TCGTCAGGACAAGATTTAGGAGAAT

SEQ ID NO: 1868 - protein, 25 aa, Homo sapiens
ACCACAGTTATTTGCGAGACACCGG

SEQ ID NO: 1869 - protein, 25 aa, Homo sapiens
TCAAAGTCGCAGCTTTCACCGGTCT

SEQ ID NO: 1870 - protein, 25 aa, Homo sapiens
CAAAGTCGCAGCTTTCACCGGTCTT

SEQ ID NO: 1871 - protein, 25 aa, Homo sapiens
CGTCAAAGTCGCAGCTTTCACCGGT

SEQ ID NO: 1872 - protein, 25 aa, Homo sapiens
AAAGTCGCAGCTTTCACCGGTCTTT

SEQ ID NO: 1873 - protein, 25 aa, Homo sapiens
GACGTGGACAATAGAACTCTTTGAC

SEQ ID NO: 1874 - protein, 25 aa, Homo sapiens
TCAGAGTAGAGACACTCAGACGTGG

SEQ ID NO: 1875 - protein, 25 aa, Homo sapiens
GTCCTAGTGGGTGGTTTCTATCCAC

SEQ ID NO: 1876 - protein, 25 aa, Homo sapiens
CCACAGTGGATCCTCTGGAAGAAAC

SEQ ID NO: 1877 - protein, 25 aa, Homo sapiens
TACCTCCTTCGATACTCGTTATGTC

SEQ ID NO: 1878 - protein, 25 aa, Homo sapiens
GGACTTTGGTACAACTGATTTCTAC

SEQ ID NO: 1879 - protein, 25 aa, Homo sapiens
ACGGGTCCTTTGTGTGCCTTAAGGC

SEQ ID NO: 1880 - protein, 25 aa, Homo sapiens
GCCTTAAGGCAGAGTAAAGTAACAG

SEQ ID NO: 1881 - protein, 25 aa, Homo sapiens
CTCTCTCCTTGTGGACGTGGTTGAC

SEQ ID NO: 1882 - protein, 25 aa, Homo sapiens
CTACAGGAGTTGGTCGATGTGCATG

SEQ ID NO: 1883 - protein, 25 aa, Homo sapiens
GTTGGTCGATGTGCATGTCGAGTAC

SEQ ID NO: 1884 - protein, 25 aa, Homo sapiens
GGGGCCTGAGCTTTGTACCTGGACC

SEQ ID NO: 1885 - protein, 25 aa, Homo sapiens
GGTCGATGTGCATGTCGAGTACCTC

SEQ ID NO: 1886 - protein, 25 aa, Homo sapiens
ATCTCATGAAACTAGAGTTGTGTCT

SEQ ID NO: 1887 - protein, 25 aa, Homo sapiens
GGTCGCGGTTGTTATTGTGCATGAC

SEQ ID NO: 1888 - protein, 25 aa, Homo sapiens
ACGTACTCCTGGTAGTTACTCTGAG

SEQ ID NO: 1889 - protein, 25 aa, Homo sapiens
CACTTAAACGTTGACCGAAGGATCT

SEQ ID NO: 1890 - protein, 25 aa, Homo sapiens
GTCCGGAGTGCACGAAGTGGGTGCT

SEQ ID NO: 1891 - protein, 25 aa, Homo sapiens
AGTGCACGAAGTGGGTGCTGTTGGT

SEQ ID NO: 1892 - protein, 25 aa, Homo sapiens
ACCGTCTGCCGCGGAAAGACCTGTG

SEQ ID NO: 1893 - protein, 25 aa, Homo sapiens
TGCTGTTGGTCGTGACCGTCTGCCG

SEQ ID NO: 1894 - protein, 25 aa, Homo sapiens
AGTTCGCGGACGTCTTGTTGCTGTG

SEQ ID NO: 1895 - protein, 25 aa, Homo sapiens
ACGAGTTCGCGGACGTCTTGTTGCT

SEQ ID NO: 1896 - protein, 25 aa, Homo sapiens
GACGAGTTCGCGGACGTCTTGTTGC

SEQ ID NO: 1897 - protein, 25 aa, Homo sapiens
GGACGTCTTGTTGCTGTGCACGTCG

SEQ ID NO: 1898 - protein, 25 aa, Homo sapiens
ACCGACAACGCCCTCGTCTTCGCGT

SEQ ID NO: 1899 - protein, 25 aa, Homo sapiens
ACAACGCCCTCGTCTTCGCGTTCTT

SEQ ID NO: 1900 - protein, 25 aa, Homo sapiens
GACAACGCCCTCGTCTTCGCGTTCT

SEQ ID NO: 1901 - protein, 25 aa, Homo sapiens
CCACACCGACAACGCCCTCGTCTTC

SEQ ID NO: 1902 - protein, 25 aa, Homo sapiens
TCTCCGAGGTCAGACGTAGGAAAGT

SEQ ID NO: 1903 - protein, 25 aa, Homo sapiens
GTGTTTCCGGCGGAGTTCGTGTCTC

SEQ ID NO: 1904 - protein, 25 aa, Homo sapiens
CTCCGAGGTCAGACGTAGGAAAGTC

SEQ ID NO: 1905 - protein, 25 aa, Homo sapiens
TGTTTCCGGCGGAGTTCGTGTCTCC

SEQ ID NO: 1906 - protein, 25 aa, Homo sapiens
CTTTTTCGCCGGTCTTCTTACACTG

SEQ ID NO: 1907 - protein, 25 aa, Homo sapiens
TCGCCGGTCTTCTTACACTGACAGT

SEQ ID NO: 1908 - protein, 25 aa, Homo sapiens
TTCGCCGGTCTTCTTACACTGACAG

SEQ ID NO: 1909 - protein, 25 aa, Homo sapiens
CCGGTCTTCTTACACTGACAGTGTT

SEQ ID NO: 1910 - protein, 25 aa, Homo sapiens
GTCTTGTTTTAATTCTTGGACTCCC

SEQ ID NO: 1911 - protein, 25 aa, Homo sapiens
TAATTCTTGGACTCCCTTCAGGCTC

SEQ ID NO: 1912 - protein, 25 aa, Homo sapiens
GACGTCTTGTTTTAATTCTTGGACT

SEQ ID NO: 1913 - protein, 25 aa, Homo sapiens
GGGACGTCTTGTTTTAATTCTTGGA

SEQ ID NO: 1914 - protein, 25 aa, Homo sapiens
GACCTGGACATGTTCAGGGACGTCC

SEQ ID NO: 1915 - protein, 25 aa, Homo sapiens
GGATCTCTTGCTGTGTCAGGTCACA

SEQ ID NO: 1916 - protein, 25 aa, Homo sapiens
GGTCACACTGGACCTGGACATGTTC

SEQ ID NO: 1917 - protein, 25 aa, Homo sapiens
AGGATCTCTTGCTGTGTCAGGTCAC

SEQ ID NO: 1918 - protein, 25 aa, Homo sapiens
GTCAGCGAGGTAGGCGAGTCACCGG

SEQ ID NO: 1919 - protein, 25 aa, Homo sapiens
TGTTCCGGTCGATACAGGCGTCAGC

SEQ ID NO: 1920 - protein, 25 aa, Homo sapiens
GCTTTGGAGTGGTTCGCCGTGACCG

SEQ ID NO: 1921 - protein, 25 aa, Homo sapiens
TGCCGTCCCACATGGTGCATCCGGA

SEQ ID NO: 1922 - protein, 25 aa, Homo sapiens
GCCCCTGATGTTCGAGTCGGACCGG

SEQ ID NO: 1923 - protein, 25 aa, Homo sapiens
GACGTGGACACTGTCGCCCCTGATG

SEQ ID NO: 1924 - protein, 25 aa, Homo sapiens
GTTGGAGCACGGGTTCATGATGCCC

SEQ ID NO: 1925 - protein, 25 aa, Homo sapiens
TCGACTTCGACGTATTCACGTTCCC

SEQ ID NO: 1926 - protein, 25 aa, Homo sapiens
GACTCATGGTCTGCCGCACACTCGT

SEQ ID NO: 1927 - protein, 25 aa, Homo sapiens
TGGACACAGTCGCACGACTCATGGT

SEQ ID NO: 1928 - protein, 25 aa, Homo sapiens
TGGTCGCACACTTCCTGGACACAGT

SEQ ID NO: 1929 - protein, 25 aa, Homo sapiens
CTGCGGGTCCTCCTCTTGAAAGACG

SEQ ID NO: 1930 - protein, 25 aa, Homo sapiens
TCCCAGACCGCCCTGAGGAAGAACC

SEQ ID NO: 1931 - protein, 25 aa, Homo sapiens
TTCTACTCCCAGACCGCCCTGAGGA

SEQ ID NO: 1932 - protein, 25 aa, Homo sapiens
TACTCCCAGACCGCCCTGAGGAAGA

SEQ ID NO: 1933 - protein, 25 aa, Homo sapiens
ACTCCCAGACCGCCCTGAGGAAGAA

SEQ ID NO: 1934 - protein, 25 aa, Homo sapiens
CCTGCCCTTTAGGTAGGAGTTCGAC

SEQ ID NO: 1935 - protein, 25 aa, Homo sapiens
TGTAGCAGGAGTTGTAACTGGACCG

SEQ ID NO: 1936 - protein, 25 aa, Homo sapiens
ATGGACGCCTATACCTGCCCTTTAG

SEQ ID NO: 1937 - protein, 25 aa, Homo sapiens
CTGTAACGTCCGGACCTGTATGGAC

SEQ ID NO: 1938 - protein, 25 aa, Homo sapiens
ACTCAAACTGTAGTCCCAGGGCAAG

SEQ ID NO: 1939 - protein, 25 aa, Homo sapiens
TGTGCATGTAGCATATGTGGCGGCT

SEQ ID NO: 1940 - protein, 25 aa, Homo sapiens
GTGCCAATGGTGTAGCCGGTCAAAC

SEQ ID NO: 1941 - protein, 25 aa, Homo sapiens
GCCCGCTCGACCTGTTGTGCATGTA

SEQ ID NO: 1942 - protein, 25 aa, Homo sapiens
GGTTGTACGAGGTCGCCTTCGCGAA

SEQ ID NO: 1943 - protein, 25 aa, Homo sapiens
GGTTGTACGAGGTCGCCTTCGCGAA

SEQ ID NO: 1944 - protein, 25 aa, Homo sapiens
CTTCGCGAACGTCTGGGAGTACAGC

SEQ ID NO: 1945 - protein, 25 aa, Homo sapiens
TTGTGACCTAGTACGCGATGTGCCC

SEQ ID NO: 1946 - protein, 25 aa, Homo sapiens
TGCAGGTTCTTCTACATGGGCGTGT

SEQ ID NO: 1947 - protein, 25 aa, Homo sapiens
TCTGGAGTAGTGGTTACTGTCGCAC

SEQ ID NO: 1948 - protein, 25 aa, Homo sapiens
AGGAGTACCAGTAGTCGGTACGTCG

SEQ ID NO: 1949 - protein, 25 aa, Homo sapiens
ACTGTCGCACTCGAAGAAGGCGTGC

SEQ ID NO: 1950 - protein, 25 aa, Homo sapiens
ACCTGGATTGGTCCGGGAGGTAAAC

SEQ ID NO: 1951 - protein, 25 aa, Homo sapiens
GTGACGTGAGACTACTTAGACCACT

SEQ ID NO: 1952 - protein, 25 aa, Homo sapiens
CACACTGTCTGAAGGGTGACTACGT

SEQ ID NO: 1953 - protein, 25 aa, Homo sapiens
CCGAAGGACTGATTTGAGGTCTCAC

SEQ ID NO: 1954 - protein, 25 aa, Homo sapiens
CCGTGTCGTGCTCTCGGCGTGGAAA

SEQ ID NO: 1955 - protein, 25 aa, Homo sapiens
CGCGTGAAGTAGTTGCGGAAGCACT

SEQ ID NO: 1956 - protein, 25 aa, Homo sapiens
CCACTACTTGTTCTGGGCCGCGTAG

SEQ ID NO: 1957 - protein, 25 aa, Homo sapiens
GCGTGGAAACGGCACATGGAGTTAT

SEQ ID NO: 1958 - protein, 25 aa, Homo sapiens
TTCGAGCCGGAAGGACAGCGTGGTG

SEQ ID NO: 1959 - protein, 25 aa, Homo sapiens
AGCGTGGTGGCGGACTTTCCGTCCA

SEQ ID NO: 1960 - protein, 25 aa, Homo sapiens
AACGACAGGCGTTGACACAAGAGGG

SEQ ID NO: 1961 - protein, 25 aa, Homo sapiens
GTCCAAAGTCTCCCTGGCGTCCTTG

SEQ ID NO: 1962 - protein, 25 aa, Homo sapiens
CGCCTCAGGGGACGCGGGTCGCCGG

SEQ ID NO: 1963 - protein, 25 aa, Homo sapiens
CAGGGGACGCGGGTCGCCGGGCCGG

SEQ ID NO: 1964 - protein, 25 aa, Homo sapiens
GGGGACGCGGGTCGCCGGGCCGGCC

SEQ ID NO: 1965 - protein, 25 aa, Homo sapiens
CTCAGGGGACGCGGGTCGCCGGGCC

SEQ ID NO: 1966 - protein, 25 aa, Homo sapiens
GCCTCCGTAGCCCTCCAGCTCTCGG

SEQ ID NO: 1967 - protein, 25 aa, Homo sapiens
GCGCCGGTCGGCTCAGGCCTCCGTA

SEQ ID NO: 1968 - protein, 25 aa, Homo sapiens
CAAGTGACGGGGCAGGCCTCGACCT

SEQ ID NO: 1969 - protein, 25 aa, Homo sapiens
ACACGCAGACACACAGGGCCGCTCC

SEQ ID NO: 1970 - protein, 25 aa, Homo sapiens
TGTGCACGTGTGTTCCGAGACCGAG

SEQ ID NO: 1971 - protein, 25 aa, Homo sapiens
CTACCGGGAGGACTTAAATAGTGCT

SEQ ID NO: 1972 - protein, 25 aa, Homo sapiens
CTAAGTGCAGCAAAGGTCGGTTCAC

SEQ ID NO: 1973 - protein, 25 aa, Homo sapiens
CCGCGGCCGGAGAGGTTACCGTTTA

SEQ ID NO: 1974 - protein, 25 aa, Homo sapiens
CGACCCTCCACAAGGTCGGGAAATT

SEQ ID NO: 1975 - protein, 25 aa, Homo sapiens
CCGCGCCCGACCCTCCACAAGGTCG

SEQ ID NO: 1976 - protein, 25 aa, Homo sapiens
GACCCTCCACAAGGTCGGGAAATTC

SEQ ID NO: 1977 - protein, 25 aa, Homo sapiens
CAACCGCGCCCGACCCTCCACAAGG

SEQ ID NO: 1978 - protein, 25 aa, Homo sapiens
CGACCTACGCCTATAGCAGACAGAG

SEQ ID NO: 1979 - protein, 25 aa, Homo sapiens
TCGACCTTGTAGTTACCCTAAGCCT

SEQ ID NO: 1980 - protein, 25 aa, Homo sapiens
CCGCGTAAAACCTGCTCGACCTACG

SEQ ID NO: 1981 - protein, 25 aa, Homo sapiens
TAGTCCTTGGGTCGTTGACACGGCG

SEQ ID NO: 1982 - protein, 25 aa, Homo sapiens
GACATTCCTGTTACGATGGGGTCAC

SEQ ID NO: 1983 - protein, 25 aa, Homo sapiens
TCCTTGAGGCCCGAGACCTATCACT

SEQ ID NO: 1984 - protein, 25 aa, Homo sapiens
ATACCTTTGTACCTACTCAAATGGG

SEQ ID NO: 1985 - protein, 25 aa, Homo sapiens
CCGGACTCACCGGACAAACGGTGGG

SEQ ID NO: 1986 - protein, 25 aa, Homo sapiens
CGCGAAGATAGCAAACGACGTTTAG

SEQ ID NO: 1987 - protein, 25 aa, Homo sapiens
ATTCCTCTTCTGGAACTGGGATTAG

SEQ ID NO: 1988 - protein, 25 aa, Homo sapiens
GGACTCGCCGATCAGAAATTCTACG

SEQ ID NO: 1989 - protein, 25 aa, Homo sapiens
CGTTTAGGCTCGTCTTCGGGAGGAC

SEQ ID NO: 1990 - protein, 25 aa, Homo sapiens
ACCTACCTGTCGAACGAGTCATTGA

SEQ ID NO: 1991 - protein, 25 aa, Homo sapiens
ACGGAGAGTACATCCCGGGAAGTAG

SEQ ID NO: 1992 - protein, 25 aa, Homo sapiens
TATCGATGGCGACGAAGGTTGGTTT

SEQ ID NO: 1993 - protein, 25 aa, Homo sapiens
ACGAGTCATTGAACCCCACGGTCAG

SEQ ID NO: 1994 - protein, 25 aa, Homo sapiens
GAGACACGGACGTTTTGTCACGGGT

SEQ ID NO: 1995 - protein, 25 aa, Homo sapiens
CCCCTGTCCTGGGACCAGTATCTGT

SEQ ID NO: 1996 - protein, 25 aa, Homo sapiens
GTAGAGTTGATACCGAGGGCCGAAC

SEQ ID NO: 1997 - protein, 25 aa, Homo sapiens
TCCGTGGGTCGAGTTCTAGGAAGCG

SEQ ID NO: 1998 - protein, 25 aa, Homo sapiens
CTCGACGGATCGGATGGTGACTACT

SEQ ID NO: 1999 - protein, 25 aa, Homo sapiens
AGTTTGGGCCCATGTCTGTACGGTT

SEQ ID NO: 2000 - protein, 25 aa, Homo sapiens
GTTTCAGGACACAACCTCGTCAGCT

SEQ ID NO: 2001 - protein, 25 aa, Homo sapiens
CGGGTCAGTCCAACCGAGATCGTCT

SEQ ID NO: 2002 - protein, 25 aa, Homo sapiens
ACTCTTCCTCAATGCCTGGAGTAAG

SEQ ID NO: 2003 - protein, 25 aa, Homo sapiens
ACTTCTTCGGTCCTGGGTTGAACCC

SEQ ID NO: 2004 - protein, 25 aa, Homo sapiens
CTCGGTACACACTACGCATGACACT

SEQ ID NO: 2005 - protein, 25 aa, Homo sapiens
GAACCCGGCGGCGAAGATGTACACA

SEQ ID NO: 2006 - protein, 25 aa, Homo sapiens
AGGAACAACCACTCGAAGAACACGG

SEQ ID NO: 2007 - protein, 25 aa, Homo sapiens
AACACGGAATTAGGACACTGGGTCG

SEQ ID NO: 2008 - protein, 25 aa, Homo sapiens
GGCTTCATGTGCCTGTGATCGACGG

SEQ ID NO: 2009 - protein, 25 aa, Homo sapiens
GGACGTGTACTAGACTCCGGTCGAG

SEQ ID NO: 2010 - protein, 25 aa, Homo sapiens
ATGAGGTATTTCAACTCAGTCTCTT

SEQ ID NO: 2011 - protein, 25 aa, Homo sapiens
ACCTCCATGAGGTATTTCAACTCAG

SEQ ID NO: 2012 - protein, 25 aa, Homo sapiens
ACCTGTAACACCTCCATGAGGTATT

SEQ ID NO: 2013 - protein, 25 aa, Homo sapiens
GTGAAACCTGTAACACCTCCATGAG

SEQ ID NO: 2014 - protein, 25 aa, Homo sapiens
GACACTGGACCTTTCACCCTCGTAA

SEQ ID NO: 2015 - protein, 25 aa, Homo sapiens
AACTTTTACCCTGACCATCTGGTCC

SEQ ID NO: 2016 - protein, 25 aa, Homo sapiens
ACCCTCGTAACGAAACTTGTGTCAC

SEQ ID NO: 2017 - protein, 25 aa, Homo sapiens
TGTGTCACGAACGAGATCGGTTCGG

SEQ ID NO: 2018 - protein, 25 aa, Homo sapiens
GTGACACATCAAAAACCCGTAAAGG

SEQ ID NO: 2019 - protein, 25 aa, Homo sapiens
GATCGAGAAACGTTGAGTGACACAT

SEQ ID NO: 2020 - protein, 25 aa, Homo sapiens
GTCACTTCGCAGTTAGGGACCTAAA

SEQ ID NO: 2021 - protein, 25 aa, Homo sapiens
CGTGAACAGACAAGGGACAGGTTAT

What is claimed is:

1. A method for treating a subject having prostate cancer, comprising:
   a) obtaining a post-operative radiation therapy outcome score (PORTOS) that has been calculated using a level of expression of a plurality of genes in the biological sample, wherein said plurality of genes comprises DRAM1, KRT14, PTPN22, ZMAT3, ARHGAP15, IL1B, ANLN, RPS27A, MUM1, TOP2A, GNG11, CDKN3, HCLS1, DTL, IL7R, UBA7, NEK1, CDKN2AIP, APEX2, KIF23, SULF2, PLK2, EME1, and BIN2;
   b) determining whether or not the subject is likely to benefit from post-operative radiation therapy based on the PORTOS score, wherein a PORTOS greater than 0 indicates that the subject will benefit from the post-operative radiation therapy and a PORTOS less than or equal to 0 indicates that the subject will not benefit from the post-operative radiation therapy; and
   c) if the PORTOS indicates that the subject will benefit from the radiation therapy, then administering the post-operative radiation therapy to the subject, and if the PORTOS does not indicate that the subject will benefit from the post-operative radiation therapy, then administering a cancer treatment other than the post-operative radiation therapy to the subject.

2. The method of claim 1, wherein the subject has previously undergone a radical prostatectomy.

3. The method of claim 1, wherein the prostate cancer has not metastasized.

4. The method of claim 1, wherein the biological sample is a biopsy.

5. The method of claim 1, wherein the biological sample is a tumor sample.

6. The method of claim 1, wherein the subject is a human being.

7. The method of claim 1, wherein the level of expression has been measured by performing microarray analysis, polymerase chain reaction (PCR), reverse transcriptase polymerase chain reaction (RT-PCR), a Northern blot, or serial analysis of gene expression (SAGE).

8. The method of claim 1, wherein said administering post-operative radiation therapy to the subject, or administering a cancer treatment other than the post-operative radiation therapy to the subject further comprises performing chemotherapy, immunotherapy, hormonal therapy, biologic therapy, or any combination thereof.

9. The method of claim 1, wherein the PORTOS indicates that the subject will benefit from the radiation therapy, and administering the post-operative radiation therapy to the subject.

* * * * *